(12) United States Patent
Margarit Y Ros et al.

(10) Patent No.: US 8,287,885 B2
(45) Date of Patent: Oct. 16, 2012

(54) GAS57 MUTANT ANTIGENS AND GAS57 ANTIBODIES

(75) Inventors: Immaculada Margarit Y Ros, Siena (IT); Guido Grandi, Milan (IT); Chiara Zingaretti, Ravenna (IT)

(73) Assignee: Novartis AG, Basel (CH)

( * ) Notice: Subject to any disclaimer, the term of this patent is extended or adjusted under 35 U.S.C. 154(b) by 0 days.

(21) Appl. No.: 12/676,192

(22) PCT Filed: Sep. 12, 2008

(86) PCT No.: PCT/IB2008/003078
§ 371 (c)(1),
(2), (4) Date: Jan. 5, 2011

(87) PCT Pub. No.: WO2009/034473
PCT Pub. Date: Mar. 19, 2009

(65) Prior Publication Data
US 2011/0110967 A1     May 12, 2011

Related U.S. Application Data

(60) Provisional application No. 60/971,637, filed on Sep. 12, 2007.

(51) Int. Cl.
*A61K 39/09* (2006.01)
*A61K 39/02* (2006.01)
*A61K 39/00* (2006.01)
*A61K 38/00* (2006.01)
*C07K 1/00* (2006.01)

(52) U.S. Cl. ............... 424/244.1; 424/234.1; 424/190.1; 424/184.1; 514/1.1; 530/350; 530/825

(58) Field of Classification Search .................. None
See application file for complete search history.

(56) References Cited

U.S. PATENT DOCUMENTS

| | | | |
|---|---|---|---|
| 4,454,121 A | 6/1984 | Beachey | |
| 5,098,827 A | 3/1992 | Boyle et al. | |
| 5,354,846 A | 10/1994 | Kehoe | |
| 5,378,620 A | 1/1995 | Adams et al. | |
| 5,391,712 A | 2/1995 | Adams et al. | |
| 5,445,820 A | 8/1995 | Seidel et al. | |
| 5,585,098 A | 12/1996 | Coleman | |
| 5,700,648 A | 12/1997 | Kehoe | |
| 5,821,088 A | 10/1998 | Darzins et al. | |
| 5,846,547 A | 12/1998 | Cleary | |
| 5,968,763 A | 10/1999 | Fischetti et al. | |
| 6,174,528 B1 | 1/2001 | Cooper et al. | |
| 6,372,222 B1 | 4/2002 | Michon et al. | |
| 6,406,883 B1 | 6/2002 | Lutticken et al. | |
| 6,420,152 B1 | 7/2002 | Adams et al. | |
| 6,579,711 B1 | 6/2003 | Gaier et al. | |
| 6,635,623 B1 | 10/2003 | Hoogeveen et al. | |
| 6,669,703 B2 | 12/2003 | Shue | |
| 6,737,521 B1 | 5/2004 | Fischetti et al. | |
| 6,747,437 B2 | 6/2004 | Chiu | |
| 6,777,547 B1 | 8/2004 | Podbielski | |
| 6,833,356 B1 | 12/2004 | Koenig et al. | |
| 6,936,252 B2 | 8/2005 | Gilbert et al. | |
| 7,033,765 B1 | 4/2006 | Dime et al. | |
| 7,041,814 B1 | 5/2006 | Weinstock et al. | |
| 7,098,182 B2 | 8/2006 | Le Page et al. | |
| 7,101,692 B2 | 9/2006 | Schneewind et al. | |
| 7,128,918 B1 | 10/2006 | Hamel et al. | |
| 7,128,919 B2 | 10/2006 | Adderson et al. | |
| 7,169,902 B2 | 1/2007 | Podbielski | |
| 7,247,308 B2 | 7/2007 | Martin et al. | |
| 7,348,006 B2 | 3/2008 | Contorni et al. | |
| 7,407,664 B2 | 8/2008 | Beall et al. | |
| 7,438,912 B2 | 10/2008 | Meinke et al. | |
| 7,485,710 B2 | 2/2009 | Reinscheid et al. | |
| 7,638,136 B2 | 12/2009 | Meinke | |
| 2002/0025516 A1 | 2/2002 | Black et al. | |
| 2002/0045737 A1 | 4/2002 | Choi et al. | |
| 2002/0061569 A1 | 5/2002 | Haselbeck et al. | |
| 2002/0086023 A1 | 7/2002 | Dale | |
| 2003/0035805 A1 | 2/2003 | Michel et al. | |
| 2003/0109690 A1 | 6/2003 | Ruben et al. | |
| 2003/0157122 A1 | 8/2003 | Dale | |
| 2003/0171337 A1 | 9/2003 | Aylward et al. | |
| 2004/0029129 A1 | 2/2004 | Wang et al. | |
| 2004/0101536 A1 | 5/2004 | Teti et al. | |
| 2004/0219639 A1 | 11/2004 | Potter et al. | |
| 2004/0236072 A1 | 11/2004 | Olmsted et al. | |
| 2005/0019345 A1 | 1/2005 | Podbielski | |

(Continued)

FOREIGN PATENT DOCUMENTS

EP          0369825          5/1990

(Continued)

OTHER PUBLICATIONS

Abbas et al., *Cellular and Molecular Immunology*, 4th ed., Chapter 15, pp. 360-362, 2000.
Amara et al., "Molecular detection of methionine in rat brain using specific antibodies," Neurosci. Lett. 185, 147-50, Feb. 13, 1995.
Areschoug et al., "Group B streptococcal surface proteins as targets for protective antibodies: identification of two novel proteins in strains of serotype V.," Inf. Immun. 67(12), 6350-57, Dec. 1999.
Banks et al., "Progress toward characterization of the Group A *Streptococcus* metagenome: Complete genome sequence of a macrolide-resistant serotype M6 strain," *J. Infectious Diseases* 190, 727-38, Aug. 15, 2004.
Barnett & Scott, "Differential recognition of surface proteins in *Streptococcus pyogenes* by two sortase gene homologs," J. Bacteriol. 184, 2181-91, 2002.
Barnett et al., "A Novel Sortase, SrtC2, from *Streptococcus pyogenes* Anchors a Surface Protein Containing a QVPTGV Motif to the Cell Wall," *Journal of Bacteriology*, vol. 186, No. 17, pp. 5865-5875, Sep. 2004.

(Continued)

*Primary Examiner* — S. Devi
(74) *Attorney, Agent, or Firm* — Banner & Witcoff, Ltd.

(57) ABSTRACT

The invention provides mutants of GAS57 which are unable to cleave IL-8 and similar substrates but which still maintain the ability to induce protection against *S. pyogenes*. The invention also provides antibodies which specifically bind to GAS57 and which inhibit its ability to cleave IL-8 and similar substrates. The mutants are useful, inter alia, in vaccine compositions to induce protection against *S. pyogenes*. The antibodies are useful, e.g., as therapeutics for treating *S. pyogenes* infections.

5 Claims, 45 Drawing Sheets

U.S. PATENT DOCUMENTS

| | | | |
|---|---|---|---|
| 2005/0020813 | A1 | 1/2005 | Masignani et al. |
| 2005/0181388 | A1 | 8/2005 | Edwards et al. |
| 2005/0214918 | A1 | 9/2005 | Edwards et al. |
| 2005/0288866 | A1 | 12/2005 | Sachdeva |
| 2006/0039922 | A1 | 2/2006 | Mizzen et al. |
| 2006/0041961 | A1 | 2/2006 | Abad et al. |
| 2006/0073530 | A1 | 4/2006 | Schneewind et al. |
| 2006/0115479 | A1 | 6/2006 | Reinscheid et al. |
| 2006/0160121 | A1 | 7/2006 | Mounts et al. |
| 2006/0165716 | A1 | 7/2006 | Telford et al. |
| 2006/0194751 | A1 | 8/2006 | Meinke et al. |
| 2006/0210579 | A1 | 9/2006 | Telford et al. |
| 2006/0210580 | A1 | 9/2006 | Telford et al. |
| 2006/0210581 | A1 | 9/2006 | Telford et al. |
| 2006/0210582 | A1 | 9/2006 | Telford et al. |
| 2006/0258849 | A1 | 11/2006 | Telford et al. |
| 2006/0269541 | A1 | 11/2006 | Meinke et al. |
| 2006/0275315 | A1 | 12/2006 | Telford et al. |
| 2007/0036828 | A1 | 2/2007 | Rappuoli et al. |
| 2007/0053924 | A1 | 3/2007 | Tettelin et al. |
| 2007/0065464 | A1 | 3/2007 | Grandi et al. |
| 2007/0098737 | A1 | 5/2007 | Dale |
| 2007/0116712 | A1 | 5/2007 | Hamel et al. |
| 2007/0128210 | A1 | 6/2007 | Olmsted et al. |
| 2007/0128211 | A1 | 6/2007 | Olmsted et al. |
| 2007/0128229 | A1 | 6/2007 | Olmsted et al. |
| 2007/0141635 | A1 | 6/2007 | James |
| 2008/0038268 | A1 | 2/2008 | Martin et al. |
| 2008/0220010 | A1 | 9/2008 | Telford et al. |
| 2009/0022753 | A1 | 1/2009 | Olmsted et al. |

FOREIGN PATENT DOCUMENTS

| | | |
|---|---|---|
| EP | 0613947 | 1/1994 |
| EP | 555438 | 1/1997 |
| EP | 555439 | 10/1997 |
| EP | 1770171 | 4/2007 |
| GB | 2233977 | 1/1991 |
| WO | WO9803677 | 1/1988 |
| WO | WO9906951 | 6/1990 |
| WO | WO9305155 | 3/1993 |
| WO | WO9305156 | 3/1993 |
| WO | WO9801561 | 1/1998 |
| WO | WO9818931 | 5/1998 |
| WO | WO9819689 | 5/1998 |
| WO | WO9823631 | 6/1998 |
| WO | WO9836777 | 8/1998 |
| WO | WO9913084 | 3/1999 |
| WO | WO9916882 | 4/1999 |
| WO | WO9926969 | 6/1999 |
| WO | WO9942588 | 8/1999 |
| WO | WO9954457 | 10/1999 |
| WO | WO0006736 | 2/2000 |
| WO | WO0006737 | 2/2000 |
| WO | WO0023456 | 4/2000 |
| WO | WO0034487 | 6/2000 |
| WO | WO0062804 | 10/2000 |
| WO | WO0078787 | 12/2000 |
| WO | WO0132882 | 5/2001 |
| WO | WO0212294 | 2/2002 |
| WO | WO02075507 | 9/2002 |
| WO | WO02092818 | 11/2002 |
| WO | WO03068813 | 8/2003 |
| WO | WO03087353 | 10/2003 |
| WO | WO03093306 | 11/2003 |
| WO | WO2004018646 | 3/2004 |
| WO | WO2004035618 | 4/2004 |
| WO | WO2004041157 | 5/2004 |
| WO | WO 2004/078907 | 9/2004 |
| WO | WO2004099242 | 11/2004 |
| WO | WO2005013666 | 2/2005 |
| WO | WO2005028618 | 3/2005 |
| WO | WO 2005032582 | 4/2005 |
| WO | WO2005076010 | 8/2005 |
| WO | WO2005108419 | 11/2005 |
| WO | WO2006035311 | 4/2006 |
| WO | WO2006042027 | 4/2006 |
| WO | WO2006069200 | 6/2006 |
| WO | WO2006078318 | 7/2006 |
| WO | WO2006082527 | 8/2006 |
| WO | WO2006082530 | 8/2006 |
| WO | WO2006130328 | 12/2006 |
| WO | WO2007018563 | 2/2007 |
| WO | WO2007039319 | 4/2007 |
| WO | WO2007052168 | 5/2007 |
| WO | WO2008020335 | 2/2008 |
| WO | WO2008108830 | 9/2008 |
| WO | WO2008003515 | 10/2008 |

OTHER PUBLICATIONS

Beckmann et al., "Identification of Novel Adhesins from Group B Streptococci by Use of Phage Display Reveals that C5a Peptidase Mediates Fibronectin Binding," Inf. Immun. 70, 2869-76, Jun. 2002.

Bessen et al., "Genomic Localization of a T Serotype Locus to a Recombinatorial Zone Ending Extracellular Matrix-Binding Proteins in Streptococcus pyogenes," Infection and Immunity, vol. 70, No. 3, pp. 1159-1167, Mar. 2002.

Black et al: "Streptococcus pneumoniae polypeptide coding region"; GENBANK Accession No. AAV42990, Nov. 9, 1998.

Blackburn et al., "The end of the (DNA) line," Nature Structural Biology 7, 847-49, Oct. 2000.

Bork et al., "Powers and pitfalls in sequence analysis: the 70% hurdle," Genome Research 10, 398-400, 2000.

Borovec et al., "Synthesis and assembly of hepatitis A virus-specific proteins in BS-C-1 cells," J. Virol. 67, 3095-301, Jun. 1993.

Bowie et al., "Deciphering the message in protein sequences: tolerance to amino acid substitution," Science 257, 1306-10, 1990.

Brodeur et al., "Identification of group B streptococcal Sip protein, which elicits cross-protective immunity," Inf. Immun. 68(10), 5610-8, Oct. 2000.

Burgess et al., "Possible dissociation of the heparin-binding and mitogenic activities of heparin-binding (acidic fibroblast) growth factor-1 from its receptor-binding activities by site-directed mutagenesis of a single lysine residue," J. Cell Biol. 111, 2129-38, 1990.

Chung et al., "chlorosome protein," NCBI Accession No. 2115394F, Jul. 10, 1992.

Clancy et al., "Cloning and Characterization of a Novel Macrolide Efflux Gene, mreA, from Streptococcus agalactiae," Antimicrobial Agents and Chemotherapy 41, 2719-23, 1997.

Collins et al., "Mutation of the principal sigma factor causes loss of virulence in a strain of the Mycobacterium tuberculosis complex," Proc. Natl. Acad. Sci. USA 92, 8036-40, 1995.

Dale et al., "New Protective Antigen of Gorup A Streptococci," J. Clin. Invest. 103, 1261-68, May 1999.

Dale et al., "Recombinant, octavalent group A Streptococcal M protein vaccine," Vaccine 14, 944-48, 1996.

Dale, "Multivalent group a streptococcal vaccine designed to optimize the immunogenicity of six tandem M protein fragments," Vaccine 17, 193-200, 1999.

Database EMBL, Accession No. AAX13129, Enterococcus faecalis genome contig SEQ ID No. 192, Mar. 19, 1999.

Database EPO Proteins, EBI Accession No. AX605513, "Sequence 3442 from WO0209818," Feb. 17, 2003.

Database Geneseq, "Group B Streptococcus protein sequence SEQ ID No. 49," EBI Accession No. GSP:AAY91320, May 30, 2000.

Database Geneseq, "Streptococcus agalactiae protein, SEQ ID 2382," EBI Accession No. GSP:ADV81242, Feb. 24, 2005.

Database Geneseq, "Fibrinogen-binding polypeptide, SEQ ID No:17," EBI Accession No. GSP: ADS93952, Dec. 2, 2004; revised in 2007.

Database Geneseq, EBI Accession No. GSP: ABP30134, "Streptococcus polypeptide SEQ ID No:9444," Jul. 2, 2002.

Database Geneseq, EBI Accession No. GSP: ABP27285, "Streptococcus polypeptide SEQ ID No:3746," Jul. 2, 2002; revised in 2007.

Database Genseq, "Protein encoded by Prokaryotic essential gene #319788," Accession No. ABU46451, Jun. 13, 2003.

Database JPO Proteins, "Nucleic acid and protein originating in group B Streptococcus," EBI Accession No. JPOP:BD629260, Jul. 17, 2003.

Database Swissprot[Online] Oct. 1, 2002, accession No. EBI, Database accession No. Q9PGX9, Hypothetical protein XF0167.
Database UniProt [Online] Mar. 1, 2003, "Cell wall surface anchor family protein," retrieved from EBI accession No. UNIPROT: Q8DYR5, Database accession No. Q8DYR5, 87.2% identity with SEQ ID No. 20906.
Database UniProt [Online], Nov. 22, 2005, "Cell wall surface anchor family protein," retrieved from EBI accession No. UNIPROT: Q3D2D6; 100% identity with SEQ ID No. 20906; abstract.
De Boever et al., "*Enterococcus faecalis* conjugative plasmid pAM373. Complete nucleotide sequence and genetic analyses of sec phermone response," Mol. Microbiol. 37, 1327-41, 2000.
Dittmer et al., "Treatment of infectious diseases with immunostimulatory oligodeoxynucleotides containing CpG motifs," Curr. Opinion Microbiol. 6, 472-77, Oct. 2003.
Duez, "*Enterococcus hirae* mraR, pbp3s, mraY, murD, murG, ftsQ and ftsA genes, mraW, yIIC and ftsZ partial genes," GENBANK Accesion No. Y13922, Apr. 18, 2005.
Ellis, Vaccines, Chapter 29, Plotkin et al., eds., W.B. Saunders Company (Philadelphia), pp. 568-575, 1988.
Examination Report for NZ 560966, Mar. 4, 2009, 2 pages.
Ferretti et al., "Putative surface exclusion protein," GENBANK Accession No. Q9A1H3, Oct. 31, 2006.
Ferretti et al: "*Streptococcus pyogenes* M1 GAS strain SF370, Section 87 of 167 of the complete genome" Database Accession No. AE006558.
Glaser et al., "Genome sequence of *Streptococcus agalactiae*, a pathogen causing invasive neonatal disease," Mol. Moicrobiol. 45, 1499-1513, 2002.
Grandi & Zagursky, "The impact of genomics in vaccine discovery: achievements and lessons," Expert. Rev. Vaccines 3, 621-23, 2004.
Grandi, "Genomics and Proteomics in Reverse Vaccines," in *Microbial Proteomics: Functional Biology of Whole Organisms*, Humphery-Smith & Hecker, eds., John Wiley & Sons, chapter 20, 2006.
Greenspan et al., "Defining epitopes: Its not as easy as it seems," Nature Biotechnol. 7, 936-37, 1999.
Gutekunst et al., "Analysis of RogB-Controlled Virulence Mechanisms and Gene Expression in *Streptococcus agalactiae*," Inf. Immun. 71, 5056-64, Sep. 2003.
Gutierrez et al., "insertional Mutagenesis and Recovery of Interrupted Genes of *Streptococcus mutans* by Using Transposon Tn917: Preliminary Characterization of Mutants Displaying Acid Sensitivity and Nutritional Requirements," J. Bacteriol. 178, 4166-75, Jul. 1996.
Guttierez et al., "*Streptococcus mutans* ProX (pouABC) gene, partial cds; YIxM (yIxM) gene, complete cds; Ffh (ffh) gene, complete cds, alternatively spliced; SatC (satC) and SatD (satD) gene, complete cds; and SatE (satE) gene, partical cds," GENBANK Accession No. U88582, Apr. 3, 2001.
Guzman et al., "Protective immune response against *Streptococcus pyogenes* in mice after intranasal vaccination with the fibronectin-binding protein Sfbl," J. Infectious Disease 179, 901-06, 1999.
Holmes, "PSMA specific antibodies and their diagnostic and therapeutic use," Exp. Opin. Invest. Drugs 10, 511-10, 2001.
Hong, "unnamed protein product [*Streptococcus pyogenes*]," NCBI Accession No. BAB16036, one page, Oct. 3, 2000.
Horvath et al., "Toward the development of a synthetic group a streptococcal vaccine of high purity and broad protective coverage," J Med Chem. Jul. 29, 2004;47(16):4100-4.
Hughes et al., "Identification of Major Outer surface Proteins of *Streptococcus agalactiae*," Inf. Immun. 70, 1254-59, Mar. 2002.
International Preliminary Examination Report for PCT/GB01/04789 (published as WO 02/34771) dated Feb. 17, 2003.
International Preliminary Examination Report for PCT/GB2003/001882 (published as WO 03/093306) dated Aug. 18, 2004.
International Preliminary Examination Report for PCT/IB2005/036009 (published as WO 06/042027) dated Apr. 11, 2007.
International Preliminary Examination Report for PCT/US2003/029167 (published as WO 04/041157) dated Mar. 5, 2005.
International Preliminary Examination Report for PCT/US2004/024868 (published as WO 05/032582) dated Feb. 6, 2006.
International Preliminary Examination Report for PCT/US2004/030032 (published as WO 05/028618) dated Mar. 16, 2006.
International Search Report for PCT/GB01/04789 (published as WO 02/34771) dated Aug. 27, 2002.
International Search Report for PCT/GB2003/001882 (published as WO 03/093306) dated Nov. 14, 2002.
International Search Report for PCT/I132005/036009 (published as WO 06/042027) dated Jun. 20, 2006.
International Search Report for PCT/US05/046491 dated Jun. 26, 2007 (published as WO 2006/069200).
International Search Report for PCT/US2003/029167 (published as WO 04/041157) dated Aug. 2, 2004.
International Search Report for PCT/US2004/024868 (published as WO 05/032582) dated Oct. 28, 2005.
International Search Report for PCT/US2004/030032 (published as WO 05/028618) dated Dec. 6, 2005.
International Search Report for PCT/US2005/027239 (published as WO 06/078318) dated Aug. 25, 2008.
International Search Report for PCT/US2007/022838 (published as WO 08/108830) dated Oct. 9, 2008.
Jobling et al., "Analysis of structure and function of the B subunit of cholera toxin by the use of site-directed mutagenesis," Mol. Microbiol. 5, 1755-67, 1991.
Kalman et al., "Comparative genomes of *Chlamydia pneumoniae* and *C. trachomatis*," Nature Genetics 21, 385-89, Apr. 1999.
Kehoe et al., "Nucleotide Sequence of the Streptolysin O (SLO) Gene: Structural Homologies between SLO and Other Membrane-Damaging, Thiol-Activated Toxins," Inf. Immun. 55, 3228-32, Dec. 1987.
Koch et al., "Complexity and expression patterns of the desmosomal adherins," Proc. Natl. Acad. Sci. USA 89, 353-57, Jan. 1992.
Kunst et al., "The complete genome sequence of the Gram positive bacterium *Bacillus subtilis*," NCBI Accession No. CAB14964, Nov. 20, 1997.
Lachenauer et al., "A protective surface protein from the Type V Group B *Streptococcus* shares N-terminal sequence homology with the Alpha C Protein," Inf. Immun. 64, 4255-60, Oct. 1996.
Larsson et al., "Protection against experimental infection with group B *Streptococcus* by immunization with a bivalent protein vaccine," Vaccine 17, 454-58, 1999.
Lauer et al., "Genome Analysis Reveals Pili in Group B *Streptococcus*," Science 309, 105, Jul. 1, 2005.
Lazar et al., "Transforming growth factor alpha: mutation of aspartic acid 47 and leucine 48 results in different biological activities," Mol. Cell. Biol. 8, 1247-52, 1988.
Le Page et al., *Streptococcus agalactiae* sequence 217 from WO 01/32882, GENBANK Accession No. AX134653, May 29, 2001.
Lei et al., "Identification and immunogenicity of group A *Streptococcus* culture supernatant proteins," Inf. Immunity 68, 6807-18, 2000.
Lewis, "Riddle of Biofilm Resistance," *Antimicrobial Agents and Chemotherapy*, vol. 45, No. 4, pp. 999-1007, Apr. 2001.
Lindahl et al., "Surface proteins of *Streptococcus agalactiae* and related proteins in other bacterial pathogens," Clinical Microbiol. Rev. 18(1), 102-07, Jan. 2005.
Madoff et al., "Maternal Immunization of Mice with Group B Streptococcal Type III Polysaccharide-Beta C Protein Conjugate Elicits Protective Antibody to Multiple Serotypes," J. Clinical Invest. 94, 286-92, 1994.
Maione et al., "Identification of a Universal Group B *Streptococcus* Vaccine by Multiple Genome Screen," Science 309, 148-50, Jul. 1, 2005.
McMillan et al., "Identification and assessment of new vaccine candidates for group A Streptococcal infections," Vaccine 22, 2783-90, 2004.
McMillan et al., "Prospecting for new group A Streptococcal vaccine candidates," Indian J. Med. Res. 119, 121-25, May 2004.
Meehan & Owen, "Sequence 1 from Patent WO9801561," GENBANK Accession No. May 6, 1999.
Michel et al: "Cloned alpha and beta C-protein antigens of group B *Streptococci* elicit protective immunity"; Infection and Immunity; vol. 59, No. 6, Jun. 1991; pp. 2023-2028.
Molling et al., "Naked DNA for vaccine or therapy," J. Mol. Med. 75, 242-46, 1997.

Mora et al., "Group A *Streptococcus* produce pilus-like structures containing protective antigens and Lancefield T antigens," Proc. Natl. Acad. Sci. USA 102, 1564-146, Oct. 25, 2005.

Musser, "The Next Chapter in Reverse Vaccinology," Nat. Biotechnol. 24, 157-58, 2006.

Nakagawa et al., "Genome sequence of an M3 strain of *Streptococcus pyogenes* reveals a large-scale genomic rearrangement in invasive strains and new insights into phage evolution," *Genome Res. 13*, 1042-55, Jun. 2003.

Nakata et al., "MsmR, a specific positive regulator of the *Streptococcus pyogenes* FCT pathogenicity region and cytolysin-mediated translocation system genes," Mol. Microbiol. 57, 786-803, 2005.

Navarre et al., "Surface Proteins of Gram-Positive Bacteria and Mechanisms of Their Targeting to the Cell Wall Envelope," *Microbiology and Molecular Biology Reviews*, vol. 63, No. 1, pp. 174-229, Mar. 1999.

NCBI News, table on p. 4, "Microbial Genomes Available for BLAST Search," Jul. 1998.

Orefici et al., "Possible virulence marker for *Streptococcus agalactiae* (Lancefiled Group B)," J. Clin. Microbiol. Infectious Diseases 7, 302-05, 1988.

Paoletti et al., "Neonatal mouse protection against infection with multiple group B *Streptococcal* (GBS) serotypes by maternal immunization with a tetravalent GBS polysaccharide-tetanus toxoid conjugate vaccine," Inf. Immun. 62, 3236-43, 1994.

Paoletti, "Surface structure of group B *Streptoccoccus* important in human immunity," in *Gram Positive Pathogens*, Fischetti et al., eds., Chapter 14, pp. 137-53, 2000.

Pournaras et al., "Pheromone responses and high-level aminoglycoside resistance of conjugative plasmids of *Enterococcus faecalis* from Greece," J. Antimicrobial Chemotherapy 46, 1013-16, 2000.

Pritzlaff et al., "Genetic basis for the beta-haemolytic cytolitic activity of group B *Streptococcus*," Mol. Microbiol. 39, 236-48, 2001.

Pritzlaff et al., "*Streptococcus agalactiae* cyl gene cluster, partial sequence," GENBANK Accession No. AF157015, Feb. 8, 2001.

Proft et al., "Identification and Characterization of Novel Superantigens from *Streptococcus pyogenes*," J. Exp. Med. 189, 89-101, Jan. 4, 1999.

Pucci et al., "*Enterococcus faecalis* strain A24836 cell wall/cell division gene cluster, yllB, yllc, yllD, pbpC, mraY, murD, murG, divlB, ftsA and fitsZ genes, complete cds," Genbank Accession No. U94707, Sep. 10, 1997.

Quinn, "The response of rheumatic and non-rheumatic children to streptolysin O concentrate," J. Clin. Invest. 36, 793-802, Jun. 1957.

Ramachandran et al., "Two Distinct Genotypes of *prtF2*, Encoding a Fibronectin Binding Protein, and Evolution of the Gene Family in *Streptococcus pyogenes*," Journal of Bacteriology, vol. 186, No. 22, pp. 7601-7609, Nov. 2004.

Rodewald et al., "Neonatal mouse model of group b *Streptococcal* infection," J. Infectious Diseases 166, 635-39, 1992.

Rodriguez-Ortega et al., "Characterization and identification of vaccine candidate proteins through analysis of the group A *Streptococcus* surface proteome," Nature Biotechnol. 24, 191-97, 2006.

Roitt et al., Structure of Antigens, *Immunology*, 4th ed., Mosby, London, pp. 7.7 and 7.8, 1998.

Rosini et al., "Identification of novel genomic islands coding for antigenic pilus-like structures in *Streptococcus agalactiae*," Mol. Microbiol. 61, 126-41, 2006.

Rudenko et al., "Selection for activation of a new variant surface glycoprotein gene expression site in *Trypanosoma brucei* can result in deletion of the old one," Mol. Biochem. Parisitol. 95, 97-109, 1998; NCBI Accession No. CAD21770.

Rudinger et al., "Characteristics of the amino acids as components of a peptide hormone sequence," in *Peptide Hormones*, Parsons, ed., University Park Press, Jun. 1976, pp. 1-7.

Schneewind et al., "Sequence and Structural Characteristics of the Trypsin-Resistant T6 Surface Protein of Group A *Streptococci*," *Journal of Bacteriology*, vol. 172, No. 6, pp. 3310-3317, Jun. 1990.

Schneewind, "Structure of the Cell Wall anchor of Surface Proteins in *Staphylococcus aureus*," Science 268, 103-06, Apr. 7, 1995.

Segura et al., "*Streptococcus suis* and group B *Streptococcus* differ in their interactions with murine macrophages," FEMS Immunol. Med. Microbiol. 21, 189-95, 1998.

Seizen, "Multi-domain, cell envelope proteases of lactic acid bacteria," Antonie von Leeuwenhoek 76, 139-55, 1999.

Simpson et al., "Xylella fastidiosa 9a5c, section 136 of 229 of the complete genome," GENBANK Accession No. AE003990, Jun. 4, 2004.

Smoot et al., "Genome sequence and comparative microarray analysis of serotype M18 group A *Streptococcus* strains associated with acute rheumatic fever outbreaks," *Proc. Natl. Acad. Sci. USA 99*, 4668-73, Apr. 2, 2002.

Spellerberg et al., "*Streptococcus agalactiae* cyl gene cluster, complete sequence," GENBANK Accession No. AF093787, Jul. 31, 2000.

Spellerberg et al: "Identification of genetic determinants for the hemolytic activity of *Streptococcus agalactiae* by ISSI transposition"; J. Bacteriol.; vol. 181, No. 10, May 1999; pp. 3212-3219.

Stalhammar-Carlemalm et al: "The R28 Protein of *Streptococcus pyogenes* is related to several group B *Streptococcal* surface proteins, confer protective immunity and promotes binding to human epithelial cells"; Mol. Microbiol. 1, Jul. 1999, pp. 208-219.

Stephenson et al., "The Fap1 fimbrial adhesin is a glycoprotein: antibodies specific for the glycan moiety block the adhesion of *Streptococcus parasanguis* in an in vitro tooth model," *Mol. Microbiol. 43*, 147-57, 2002.

Su et al., "Identification of a Xenopus cDNA that prevents mitotic catastrophe in the fission yeast *Schizosaccharomyces pombe*," Gene 145, 155-56, 1994.

Supplementary Search report for EP 03799822 (corresponding to WO 04/041157) dated Jan. 21, 2008.

Surovov & Ferretti, "Physical and Genetic Chromosomal Map of an M Type 1 Strain of *Streptococcus pyogenes*," J. Bacteriol. 178, 5546-49, Sep. 1996.

Takami et al., "Two component sensor histidine kinase involved in phosphate regulation," NCBI Accession No. NP_244022.1, Sep. 10, 2001.

Tettelin et al., "Complete genome sequence and comparative genomic analysis of an emerging human pathogen, serotype V *Streptococcus agalactiae*," Proc. Natl. Acad. Sci. USA 99, 12391-96, Sep. 17, 2002.

Tettelin et al., "Complete genome sequence of a virulent isolate of *Streptococcus pneumoniae*," Science 293, 498-506, 2001.

Tettelin et al., Database EMBL, Accession No. AE014193, *Streptococcus agalactiae* 2603V/R section 3 of 100 of the complete genome, Sep. 2, 2002.

Tettelin et al., Swiss-Prot Accession No. Q3DV91 for *Streptococcus agalactiae* strain 18R21, Nov. 22, 2005.

Tighe et al., "Gene vaccination: plasmid DNA is more than just a blueprint," Immunology Today 19, 89-97, Feb. 1998.

Todd, "Antigenic *Streptococcal* Hemolysin," J. Exp. Med. 55, 267-80, 1932.

Ton-That & Schneewind, "Assembly of pili on the surface of *Corynebacterium diphtheriae*," Mol. Microbiol. 50, 1429-38, 2003.

Ton-That et al., "Sortases and pilin elements involved in pilus assembly of *Corynebacterium diphtheriae*," Mol. Microbiol. 53, 251-61, 2004.

UniProt Accession No. A7CNQ7, Jul. 5, 2004.
UniProt Accession No. Q5XEL1, Nov. 23, 2004.
UniProt Accession No. Q8P318, Oct. 1, 2002.

Vallet et al., "The chaperone/usher pathways of *Pseudomonas aeruginosa*: Identification of fimbrial gene clusters (cup) and their involvement in biofilm formation," *PNAS*, vol. 98, No. 12, pp. 6911-6916, Jun. 2001.

Watnick et al., "Steps in the development of a *Vibrio cholerae* El Tor biofilm," *Molecular Microbiology*, vol. 34, No. 3, pp. 586-595, 1999.

Wessels et al., "Stimulation of protective antibodies against type 1a and 1b group B *Streptococci* by a type 1a polysaccharide-tetanus toxoid conjugate vaccine," Inf. Immun. 61, 4760-66, 1993.

Woodson et al., "Analysis of a ribose transport operon from *Bacillus subtilis*," Microbiology 140, 1829-38, 1994.

Zhong et al., "Hypothetical protein of *Arabidopsis thaliana*," NCBI Accession No. AAD29767, May 11, 1999.

Biswas et al., "Generation and Surface Localization of Intact M Protein in *Streptococcus pyogenes* Are Dependent on *sagA*," *Inf. Immun. 69*, 7029-38, Nov. 2001.

Dale, "Group A *Streptococcal* Vaccines," *New Vaccines and New Vaccine Technology 13*, 227-43, Mar. 1999.

Edwards et al., "Specific C-Terminal cleavage and Inactivation of Interleukin-8 by Invasive Disease Isolates of *Streptococcus pyogenes*," *J. Inf. Dis. 192*, 783-90, Sep. 1, 2005.

Gubba et al., "Replacement of Histidine 340 with alanine inactivates the group A *Streptococcus* extracellular cysteine protease virulence factor," *Inf. Immun. 68*, 3716-19, Jun. 2000.

Hidalgo-Grass et al., "A *Streptococcal* protease that degrades CXC chemokines and impairs bacterial clearance from infected tissues," *EMBO J. 25*, 4628-37, Oct. 2006.

Norrby et al., "Infections due to group A *Streptococcus*: New concepts and potential treatment strategies," *Ann. Acad. Med. Singapore 26*, 691-93, Sep. 1997.

Olive et al., "Protection of mice from group A *Streptococcal* infection by intranasal immunisation with a peptide vaccine that contains a conserved M protein B cell epitope and lacks a T cell autoepitope," *Vaccine 20*, 2816-25, Jun. 21, 2002.

Zinkernagel et al., "The IL-8 protease SpyCEP/ScpC of Group A *Streptococcus* promotes resistance to neutrophil killing," *Cell Host & Microbe 4*, 170-73, Aug. 2008.

International Search Report for PCT/US2006/018411, published as WO 2006/130328, dated Mar. 14, 2007.

Lei et al., "Identification of New Candidate Vaccine Antigens Made by *Streptococcus pyogenes*: Purification and Characterization of 16 Putative Extracellular Lipoproteins," J. Inf. Dis. 189, 79-89, Jan. 2004.

Smoot et al., "Global differential gene expression in response to growth temperature alteration in group A *Streptococcus*," Proc. Natl. Acad. Sci. USA 98, 10416-21, Aug. 28, 2001.

Cleary & Stafslien, Database Geneseq entry AAB01265, Sep. 25, 2000.

Hong, Database Geneseq entry AB030812, Oct. 3, 2000.

FIG. 2

```
  1 MEKKQRFSLRKYKSGTFSVLIGSVFLVMTTTVAADELSTMSEPTITNHAQ  50
                                    :    | | . |
  1 ....................MRKKQKLPFDKLAIALMSTSILLNAQSDI  29
                 .                .                .
 51 QQAQHLTNTELSSAESKSQDTSQITLKTNREKEQSQDLVSEPTTTELADT 100
      .      .|    ..    . :. .    ||        :    :||
 30 KANTVTEDTPATEQAVETPQPTAVSEEAPSSKETKTPQTPDDAEETIADD  79
                 .                .                .
101 DAASMANTGSDATQKSASLPPVNTDVHDWVKTKGAWDKGYKGQGKVVAVI 150
                  |.       |..|  . |     :|   || |  |||||
 80 ANDLAPQAPAKTADTPATSKATIRDLNDPSQVKTLQEKAGKGAGTVVAVI 129
                 .                .                .
151 DTGIDPAHQSMRISDVSTAKVKSKEDMLARQKAAGINYGSWINDKVVFAH 200
    | | |   |:.  |:.|  . |: .||||:   .|  || ||  |:||||  : |
130 DAGFDKNHEAWRLTDKTKARYQSKEDLEKAKKEHGITYGEWVNDKVAYYH 179
                 .                .                .
201 NYVENSDNIKENQFEDFDEDWENFEFDAEAEPKAIKKHKIYRPQSTQAPK 250
    .| ..           :
180 DYSKDGKTAVD....................................... 190
                 .                .                .
251 ETVIKTEETDGSHDIDWTQTDDDTKYESHGMHVTGIVAGNSKEAAATGER 300
                           :  || ||.||..||.           |
191 ......................QEHGTHVSGILSGNAPSETKEPYR 214
                 .                .                .
301 FLGIAPEAQVMFMRVFANDIMGSAESLFIKAIEDAVALGADVINLSLGTA 350
    |  ||||.:  |||      . :       : .|| |||  |||  |||:|  | |
215 LEGAMPEAQLLLMRVEIVNGLADYARNYAQAIIDAVNLGAKVINMSFGNA 264
                 .                .                .
351 NGAQLSGSKPLMEAIEKAKKAGVSVVVAAGNERVYGSDHDDPLATNPDYG 400
    |   .      .| : ||    |||:| .|||:   :|     ||| .||||
265 ALAYANLPDETKKAFDYAKSKGVSIVTSAGNDSSFGGKTRLPLADHPDYG 314
                 .                .                .
401 LVGSPSTGRTPTSVAAINSKWVIQRLMTVKELENRADLNHGKAIYSESVD 450
    .||.|.      .||..    :     |||   :              :  :
315 VVGTPAAADSTLTVASYSPDKQLTETATVKTAD............QQDKE 352
                 .                .                .
451 FKDIKDSLGYDKSHQFAYVKESTDAGYNAQDVKGKIALIERDPNKTYDEM 500
    :   .                 . .|||||||||||     .  : :
353 MPVLSTNRFEPNKAYDYAYANRGMKEDDFKDVKGKIALIERG.DIDFKDK 401
                 .                .                .
501 IALAKKHGALGVLIFNNKPGQSNRSMRLTANGMGIPSAFISHEFGKAMSQ 550
    || |||  ||.||||:.        |.        :       .    |
402 IANAKKAGAVGVLIYD......NQDKGFPIELPNVDQMPAAFISRKDGLL 445
                 .                .                .
551 LNGNGTGSLEFDSVVSKAPSQKGNEMNHFSNWGLTSDGYLKPDITAPGGD 600
    |  |  .: |..      |.  | .:. ||.||||.||  :||||  ||| |
446 LKENPQKTITFNATPKVLPTASGTKLSRFSSWGLTADGNIKPDIAAPGQD 495
                 .                .                .
601 IYSTYNDNHYGSQTGTSMASPQIAGASLLVKQYLEKTQPNLPKEKIADIV 650
    | |.  .| |    .||||..|  :||     |...    |     |.:    . |:
496 ILSSVANNKYAKLSGTSMSAPLVAGIMGLLQKQYETQYPDMTPSERLDLA 545
```

FIG. 2, cont.

```
 651 KNLLMSNAQIHVNPETKTTTSPRQQGAGLLNIDGAVTSGLYVTGKDNYGS  700
     | .|||.|    . : |  ||||||||  ..   | .:||| |||  |
 546 KKVLMSSATALYDEDEKAYFSPRQQGAGAVDAKKASAATMYVTDKDNTSS  595

701 .ISLGNITDTMTFDVTVHNLSNKDKTLRYDTELLTDHVDPQKGRFTLTSH  749
      : | |:.|   ||||||  |.| . | |  . || ||  .   | |
 596 KVHLNNVSDKFEVTVTVHNKSDKPQELYYQATVQTDKVDGK..LFALAPK  643

750 SLKTYQGGEVTVPANGKVTVRVTMDVSQFTKELTKQMPNGYYLEGFVRFR  799
     .|      .:|:|||   | : .|||||.|:|    | |||:||||||||:
 644 ALYETSWQKITIPANSSKQVTIPIDVSQFSKDLLAPMKNGYFLEGFVRFK  693

800 DSQDDQLNRVNIPFVGFKGQFENLAVAEESIYRLKSQGKTGFYFDESGPK  849
       :    ..||::||:|  | ||.  |.  ||   |       .
 694 QDPTKE.ELMSIPYIGFRGDFGNLSALEKPIYDSKDGSSYYHEANSDAKD  742

850 DDIYVGKHFTGLVT..................LGSETNVSTKTISDN  878
      |  | |            .. .   |.:
 743 QLDGDGLQFYALKNNFTALTTESNPWTIIKAVKEGVENIEDIESSEITET  792

879 GLHTLGTFKNADGKFILEKNAQGNPVLAISPNGDNNQDFAAFKGVFLRKY  928
      ..  | : : :.| | |  ||||||| |.|:  |.| |||
 793 IFAGTFAKQDDDSHYYIHRHANGKPYAAISPNGDGNRDYVQFQGTFLRNA  842

929 QGLKASVYHASDKEHKNPLWVSPESFKGDKNFNSDIRFAKSTTLLGTAFS  978
     . | | |   |||           |       ||    | .
 843 KNLVAEVL...DKEGNVVWTSEVTEQVVKNYNNDLASTLGSTRFEKTRWD  889

979 GKSLTGAELPDGHYHYVVSYYPDVVGAKRQEMTFDMILDRQKPVLSQATF  1028
     ||  |  . .| |||||  |||   |     ||.|.|   |  ...
 890 GKDKDGKVVANGTYTYRVRYTPISSGAKEQHTDFDVIVDNTTPEVATSAT  939

1029 DPETNRFKPEPLKDRGLAGVRKDSVFYLERKDNKPYTVTINDSYKYVSVE  1078
      .|      | :   | ::: :  |    :. | |       .|:|
 940 FSTEDRRLTLASKPKTSQPVYRERIAYTYMDEDLPTT.......EYISPN  982

1079 DNKTFVERQADGSFILPLDKAKLGDFYYMVEDFAGNVAIAKLGDHLPQTL  1128
     :. ||   :  .       |: || |.||| |||:     .  |
 983 EDGTFTLPEEAETMEGATVPLKMSDFTYVVEDMAGNITYTPVTKLLEGHS  1032

1129 GKTPIKLKLTDGNYQTKETLKDNLEMTQSDTGLVTNQAQLAVVHRNQPQS  1178
         |      ... .. ..        |   |    |
1033 NKPEQDGSDQAPDKKPETKPEQDGSGQAPDKKPETKPEQDGSGQTPDKKP  1082

1179 QLTKMNQDFFISPNEDGNKDFVAFKGLKNNVYNDLTVNVYAKDDHQKQTP  1228
     :         .|..      .                  : .
1083 ETKPEQDGSGQTPDKKPETKPEKDSSGQTPGKTPQKGQPSRTLEKRSSKR  1132

1229 IWSSQAGASVSAIESTAWYGITARGSKVMPGDYQYVVTYRDEHGKEHQKQ  1278
     ...|         .            |..   :  .   |    :
1133 ALATKASTKDQLPTTNDKDTNRLHLLKLVMTTFFLGLVAHIFKTKRTED.  1181
```

FIG. 5
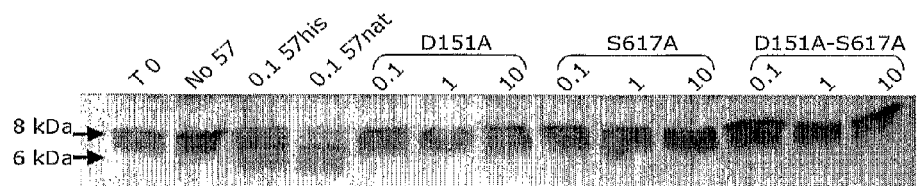
A
B

FIG. 10A

```
                                    1                                                50
     gas57M1_SF370      (1) VEKKQRFSLRKYKSGTFSVLIGSVFLVMTTT--VAADELSTMSEPTITNH
     gas57M1_31075     (1) VEKKQRFSLRKYKSGTFSVLIGSVFLVMTTT--VAADELSTMSEPTITNH
     gas57M1_31237     (1) VEKKQRFSLRKYKSGTFSVLIGSVFLVMTTT--VAADELSTMSEPTITNH
      gas57M1_3348     (1) VEKKQRFSLRKYKSGTFSVLIGSVFLVMTTT--VAADELSTMSEPTITNH
     gas57M2_34585     (1) VEKKQRFSLRKYKSGTFSVLIGSVFLVMTTT--VAADELSTMSEPTITNH
    gas57M3,1_21398    (1) VEKKQRFSLRKYKSGTFSVLIGSVFLVMTTT--VAANELSTMSEPTITNH
   gas57M44-61_20839   (1) VEKKQRFSLRKYKSGTFSVLIGSVFLVMTTT--VAADELSTMSEPTITNH
   gas57M6,31_20022    (1) VEKKQRFSLRKYKSGTFSVLIGSAFLMMTTT--VAADELSTMSEPTITNH
     gas57M11_20648    (1) VEKKQRFSLRKYKSGTFSVLIGSVFLVMTTT--VAADELSTMSEPTITNH
      gas57M23_2071    (1) VEKKQRFSLRKYKSGTFSVLIGSVFLVMTTT--VAADELSTMSEPTITNH
   gas57M18,3_40128    (1) VEKKQRFSLRKYKSGTFSVLIGSVFLMMMTTTTVAADELTTTSEPTITNH
     gas57M4_10092     (1) VEKKQRFSLRKYKSGTFSVLIGSVFLMMMTTTTVAADELTTTSEPTITNH
     gas57M4_30968     (1) VEKKQRFSLRKYKSGTFSVLIGSVFLMMMTTTTVAADELTTTSEPTITNH
   gas57M6,31_22692    (1) VEKKQRFSLRKYKSGTFSVLIGSVFLMMMTTTTVAADELTTTSEPTITNH
   gas57M68,5_22814    (1) VEKKQRFSLRKYKSGTFSVLIGSVFLMMMTTT-VAADELTTTSEPTITNH
     gas57M68_23623    (1) VEKKQRFSLRKYKSGTFSVLIGSVFLMMMTTTVAADELTTTSEPTITNH
     gas57M2_10064     (1) VEKKQRFSLRKYKSGTFSVLIGSVFLMMMTTT--VAADELTTTSEPTITNH
     gas57M2_10065     (1) VEKKQRFSLRKYKSGTFSVLIGSVFLMMTTT--VAADELTTTSEPTITNH
     gas57M77_10251    (1) VEKKQRFSLRKYKSGTFSVLIGSVFLMMTTT--VAADELTTTSEPTITNH
     gas57M77_10527    (1) VEKKQRFSLRKYKSGTFSVLIGSVFLMMTTT--VAADELTTTSEPTITNH
     gas57M77_20696    (1) VEKKQRFSLRKYKSGTFSVLIGSVFLMMTTT--VAADELTTTSEPTITNH
     gas57M89_21915    (1) VEKKQRFSLRKYKSGTFSVLVGSVFLMMTTT--VAADELTTTSEPTITNH
     gas57M89_23717    (1) VEKKQRFSLRKYKSGTFSVLVGSVFLMMTTT--VAADELTTTSEPTITNH
     gas57M94_10134    (1) VEKKQRFSLRKYKSGTFSVLIGSVFLMMTTT--VAADELTTTSEPTITNH
     gas57M28_10164    (1) VEKKQRFSLRKYKSGTFSVLIGSVFLMMTTT--VAADELTTTSEPTITNH
     gas57M28_10218    (1) VEKKQRFSLRKYKSGTFSVLIGSVFLMMTTT--VAADELTTTSEPTITNH
     gas57M28_10266    (1) VEKKQRFSLRKYKSGTFSVLIGSVFLMMTTT--VAADELTTTSEPTITNH
     gas57M28_10299    (1) VEKKQRFSLRKYKSGTFSVLIGSVFLMMTTT--VAADELTTTSEPTITNH
     gas57M28_30176    (1) VEKKQRFSLRKYKSGTFSVLIGSVFLMMTTT--VAADELTTTSEPTITNH
     gas57M28_30574    (1) VEKKQRFSLRKYKSGTFSVLIGSVFLMMTTT--VAADELTTTSEPTITNH
    gas57M6,9_21802    (1) VEKKQRFSLRKYKSGTFSVLIGSVFLMMTTT--VAADELTTTSEPTITNH
     gas57M75_10012    (1) VEKKQRFSLRKYKSGTFSVLIGSVFLMMMMTTTVAADELTTTSEPTITNH
     gas57M75_20671    (1) VEKKQRFSLRKYKSGTFSVLIGSVFLMMMMTTTVAADELTTTSEPTITNH
     gas57M75_30603    (1) VEKKQRFSLRKYKSGTFSVLIGSVFLMMMMTTTVAADELTTTSEPTITNH
     gas57M75_30207    (1) VEKKQRFSLRKYKSGTFSVLIGSVFLMMMMTTTVAADELTTTSEPTITNH
     gas57M22_20641    (1) VEKKQRFSLRKYKSGTFSVLIGSVFLMMMTTT-VAADELTTTSEPTITNH
     gas57M22_23465    (1) VEKKQRFSLRKYKSGTFSVLIGSVFLMMMTTT-VAADELTTTSEPTITNH
    gas57M3,1_30610    (1) VEKKQRFSLRKYKSGTFSVLIGSVFLMMMTTT-VAADELTTTSEPTITNH
    gas57M3,1_40603    (1) VEKKQRFSLRKYKSGTFSVLIGSVFLMMMTTT-VAADELTTTSEPTITNH
   gas57M3,28_24214    (1) VEKKQRFSLRKYKSGTFSVLIGSVFLMMMTTT-VAADELTTTSEPTITNH
   gas57M3,34_10307    (1) VEKKQRFSLRKYKSGTFSVLIGSVFLMMMTTT-VAADELTTTSEPTITNH
     gas57M4_40427     (1) VEKKQRFSLRKYKSGTFSVLIGSVFLMMMTTT-VAADELTTTSEPTITNH
      gas57M3_2721     (1) VEKKQRFSLRKYKSGTFSVLIGSVFLMMMTTT-VAADELTTTSEPTITNH
     gas57M12_10296    (1) VEKKQRFSLRKYKSGTFSVLIGSVFLMMTTT--VAADELTTTSEPTITNH
     gas57M12_10035    (1) VEKKQRFSLRKYKSGTFSVLIGSVFLMMTTT--VAADELTTTSEPTITNH
     gas57M12_20069    (1) VEKKQRFSLRKYKSGTFSVLIGSVFLMMTTT--VAADELTTTSEPTITNH
     gas57M12_22432    (1) VEKKQRFSLRKYKSGTFSVLIGSVFLMMTTT--VAADELTTTSEPTITNH
     gas57M4_40499     (1) VEKKQRFSLRKYKSGTFSVLIGSVFLMMTTT--VAADELTTTSEPTITNH
   gas57M6,1_21259     (1) VEKKQRFSLRKYKSGTFSVLIGSVFLMMTTT--VAADELTTTSEPTITNH
```

FIG. 10B

```
                                  51                                              100
    gas57M1_SF370      (49)  AQQQAQHLTNTELSSAESKSQDTSQITLKTNREKEQSQDLVSEPTTTELA
    gas57M1_31075     (49)  AQQQAQHLTNTELSSAESKSQDTSQITLKTNREKEQSQDLVSEPTTTELA
    gas57M1_31237     (49)  AQQQAQHLTNTELSSAESKSQDTSQITLKTNREKEQSQDLVSEPTTTELA
     gas57M1_3348     (49)  AQQQAQHLTNTELSSAESKSQDTSQITLKTNREKEQSQDLVSEPTTTELA
    gas57M2_34585     (49)  AQQQAQHLTNTELSSAESKSQDTSQITLKTNREKEQSQDLVSEPTTTELA
  gas57M3,1_21398     (49)  AQQQAQHLTNTELSSAESKPQDTSQITPKTNREKEQSQDLVSEPTTTELA
 gas57M44-61_20839    (49)  AQQQAQHLTNTELSSAESKSQDTSQITPKTNREKEQSQDLVSEPTTTELA
  gas57M6,31_20022    (49)  TQQQAQHLTNTELSSAESKSQDTSQITPKTNREKEQSQDLVSEP-TTELA
    gas57M11_20648    (49)  AQQQAQHLTNTELSSAESKTQDTSQITPKTNREKEQPQGLVSEPTTTELA
     gas57M23_2071    (49)  TQQQAQHLTNTELSSAESKSQDTSQITPKTNREKEQPQGLVSEP-TTELA
  gas57M18,3_40128    (51)  AQQQAQHLTNTELSSAESQSPDTSQITPKTNREKEQPQGLVSEPTTTELA
    gas57M4_10092     (51)  AQQQAQHLTNTELSSAESQSPDTSQITPKTNREKEQPQGLVSEPTTTELA
    gas57M4_30968     (51)  AQQQAQHLTNTELSSAESQSPDTSQITPKTNREKEQPQGLVSEPTTTELA
  gas57M6,31_22692    (51)  AQQQAQHLTNTELSSAESQSPDTSQITPKTNREKEQPQGLVFEPTTTELA
  gas57M68,5_22814    (50)  AQQQAQHLTNTELSSAESQSPDTSQITPKTNREKEQPQGLVSEPTTTELA
    gas57M68_23623    (51)  AQQQAQHLTNTELSSAESQSPDTSQITPKTNREKEQPQGLVSEPTTTELA
    gas57M2_10064     (49)  AQQQAPPLTNTELSSAESQPQDTSQVTPETNREKEQPQGLVSEPTTTELA
    gas57M2_10065     (49)  AQQQAPPLTNTELSSAESQPQDTSQVTPETNREKEQPQGLVSEPTTTELA
    gas57M77_10251    (49)  AQQQAPPLTNTELSSAESQSPHTSQVTPETNREKEQSQDLVSKPTTTELA
    gas57M77_10527    (49)  AQQQAPPLTNTELSSAESQSPHTSQVTPETNREKEQSQDLVSKPTTTELA
    gas57M77_20696    (49)  AQQQAPPLTNTELSSAESQSPHTSQVTPETNREKEQSQDLVSKPTTTELA
    gas57M89_21915    (49)  AQQQAPPLTNTELSSAESQSPDTSQVTPETNREKEQSQDLVSKPTTTELA
    gas57M89_23717    (49)  AQQQAPPLTNTELSSAESQSPDTSQVTPETNREKEQSQDLVSKPTTTELA
    gas57M94_10134    (49)  AQQQAPPLTNTELSSAESQSPDTSQITPKTNREKEQSQDLVSKPTTTELA
    gas57M28_10164    (49)  AQQQAQHLTNTELSSAESQSPDTSQITPKINREKEQPQGLVSEPTTTELA
    gas57M28_10218    (49)  AQQQAQHLTNTELSSAESQSPDTSQITPKINREKEQPQGLVSEPTTTELA
    gas57M28_10266    (49)  AQQQAQHLTNTELSSAESQSPDTSQITPKINREKEQPQGLVSEPTTTELA
    gas57M28_10299    (49)  AQQQAQHLTNTELSSAESQSPDTSQITPKINREKEQPQGLVSEPTTTELA
    gas57M28_30176    (49)  AQQQAQHLTNTELSSAESQSPDTSQITPKINREKEQPQGLVSEPTTTELA
    gas57M28_30574    (49)  AQQQAQHLTNTELSSAESQSPDTSQITPKINREKEQPQGLVSEPTTTELA
   gas57M6,9_21802    (50)  AQQQAQHLTNTELSSAESKPQDTSQITPKTNREKEQSQDLVSEPTTTELA
    gas57M75_10012    (51)  AQQQAQHLTNTELSSAESKPQDTSQITPKTNREKEQSQDLVSEPTTTELA
    gas57M75_20671    (51)  AQQQAQHLTNTELSSAESKPQDTSQITPKTNREKEQSQDLVSEPTTTELA
    gas57M75_30603    (51)  AQQQAQHLTNTELSSAESKPQDTSQITPKTNREKEQSQDLVFEPTTTELA
    gas57M75_30207    (51)  AQQQAQHLTNTELSSAESKPQDTSQITPKTNREKEQSQDLVSEPTTTELA
    gas57M22_20641    (50)  TQQQAQHLTNTELSSAESKPQDTSQITLKTNREKEQPQGLVSEPTTTELA
    gas57M22_23465    (50)  TQQQAQHLTNTELSSAESKPQDTSQITLKTNREKEQPQGLVSEPTTTELA
  gas57M3,1_30610     (50)  TQQQAQHLTNTELSSAESKPQDTSQITLKTNREKEQPQGLVSEPTTTELA
  gas57M3,1_40603     (50)  TQQQAQHLTNTELSSAESKPQDTSQITLKTNREKEQPQGLVSEPTTTELA
  gas57M3,28_24214    (50)  TQQQAQHLTNTELSSAESKPQDTSQITLKTNREKEQPQGLVSEPTTTELA
  gas57M3,34_10307    (50)  TQQQAQHLTNTELSSAESKPQDTSQITLKTNREKEQPQGLVSEPTTTELA
    gas57M4_40427     (50)  TQQQAQHLTNTELSSAESKPQDTSQITLKTNREKEQPQGLVSEPTTTELA
     gas57M3_2721     (50)  TQQQAQHLTNTELSSAESKPQDTSQITLKTNREKEQPQGLVSEPTTTELA
    gas57M12_10296    (49)  TQQQAQHLTNTELSSAESKPQDTSQITLKTNREKEQPQGLVSEPTTTELA
    gas57M12_10035    (49)  TQQQAQHLTNTELSSAESKPQDTSQITLKTNREKEQPQGLVSEPTTTELA
    gas57M12_20069    (49)  TQQQAQHLTNTELSSAESKPQDTSQITLKTNREKEQPQGLVSEPTTTELA
    gas57M12_22432    (49)  TQQQAQHLTNTELSSAESKPQDTSQITLKTNREKEQPQGLVSEPTTTELA
    gas57M4_40499     (49)  TQQQAQHLTNTELSSAESKPQDTSQITLKTNREKEQPQGLVSEPTTTELA
   gas57M6,1_21259    (49)  TQQQAQHLTNTELSSAESKPQDTSQITLKTNREKEQPQGLVSEPTTTELA
```

FIG. 10C

```
                            101                                              150
  gas57M1_SF370      (99)  DTDAASMANTGSDATQKSASLPPVNTDVHDWVKTKGAWDKGYKGQGKVVA
  gas57M1_31075     (99)  DTDAASMANTGSDATQKSASLPPVNTDVHDWVKTKGAWDKGYKGQGKVVA
  gas57M1_31237     (99)  DTDAASMANTGSDATQKSASLPPVNTDVHDWVKTKGAWDKGYKGQGKVVA
  gas57M1_3348      (99)  DTDAASMANTGSDATQKSASLPPVNTDVHDWVKTKGAWDKGYKGQGKVVA
  gas57M2_34585     (99)  DTDAASMANTGSDATQKSASLPPVNTDVHDWVKTKGAWDKGYKGQGKVVA
  gas57M3,1_21398   (99)  DTDAAPMADTGPDATQKSASLPPVNTDVHDWVKTKGAWDKGYKGQGKVVA
  gas57M44-61_20839 (99)  DTDAASMANTGSDATQKSASLPPVNTDVHDWVKTKGAWDKGYKGQGKVVA
  gas57M6,31_20022  (98)  DTDAAPMANTGPDATQKSASLPPVNTDVHDWVKTKGAWDKGYKGQGKVVA
  gas57M11_20648    (99)  DTDAASMADTGPDATQKSASLPPVNTDVHDWVKTKGAWDKGYKGQGKVVA
  gas57M23_2071     (98)  DTDAAPMANTGPDATQKSASLPPVNTDVHDWVKTKGAWDKGYKGQGKVVA
  gas57M18,3_40128  (101) DTDAASMANTGPDATQKSASLPPVNTDVHDWVKTKGAWDKGYKGQGKVVA
  gas57M4_10092     (101) DTDAASMANTGPDATQKSASLPPVNTDVHDWVKTKGAWDKGYKGQGKVVA
  gas57M4_30968     (101) DTDAASMANTGPDATQKSASLPPVNTDVHDWVKTKGAWDKGYKGQGKVVA
  gas57M6,31_22692  (101) DTDAASMANTGPDATQKSASLPPVNTDVHDWVKTKGAWDKGYKGQGKVVA
  gas57M68,5_22814  (100) DTDAASMANTGPDATQKSASLPPVNTDVHDWVKTKGAWDKGYKGQGKVVA
  gas57M68_23623    (101) DTDAASMANTGPDATQKSASLPPVNTDVHDWVKTKGAWDKGYKGQGKVVA
  gas57M2_10064     (99)  DTDAAPMANTGSDATQKSASLPPVNTDVHDWVKTKGAWDKGYKGQGKVVA
  gas57M2_10065     (99)  DTDAAPMANTGSDATQKSASLPPVNTDVHDWVKTKGAWDKGYKGQGKVVA
  gas57M77_10251    (99)  DTDAAPMANTGPDATQKSASLPPVNTDVHDWVKTKGAWDKGYKGQGKVVA
  gas57M77_10527    (99)  DTDAAPMANTGPDATQKSASLPPVNTDVHDWVKTKGAWDKGYKGQGKVVA
  gas57M77_20696    (99)  DTDAAPMANTGPDATQKSASLPPVNTDVHDWVKTKGAWDKGYKGQGKVVA
  gas57M89_21915    (99)  DTDAAPMANTGPDATQKSASLPPVNTDVHDWVKTKGAWDKGYKGQGKVVA
  gas57M89_23717    (99)  DTDAAPMANTGPDATQKSASLPPVNTDVHDWVKTKGAWDKGYKGQGKVVA
  gas57M94_10134    (99)  DTDSAPMANTGPDATQKSASLPPVNTDVHDWVKTKGAWDKGYKGQGKVVA
  gas57M28_10164    (99)  DTDAAPMANTGPDATQKSASLPPVNTDVHDWVKTKGAWDKGYKGQGKVVA
  gas57M28_10218    (99)  DTDAAPMANTGPDATQKSASLPPVNTDVHDWVKTKGAWDKGYKGQGKVVA
  gas57M28_10266    (99)  DTDAAPMANTGPDATQKSASLPPVNTDVHDWVKTKGAWDKGYKGQGKVVA
  gas57M28_10299    (99)  DTDAAPMANTGPDATQKSASLPPVNTDVHDWVKTKGAWDKGYKGQGKVVA
  gas57M28_30176    (99)  DTDAAPMANTGPDATQKSASLPPVNTDVHDWVKTKGAWDKGYKGQGKVVA
  gas57M28_30574    (99)  DTDAAPMANTGPDATQKSASLPPVNTDVHDWVKTKGAWDKGYKGQGKVVA
  gas57M6,9_21802   (100) DTDAASMANTGPDATQKSASLPPVNTDVHDWVKTKGAWDKGYKGQGKVVA
  gas57M75_10012    (101) DTDAASMANTGPDATQKSASLPPVNTDVHDWVKTKGAWGKGYKGQGKVVA
  gas57M75_20671    (101) DTDAASMANTGPDATQKSASLPPVNTDVHDWVKTKGAWGKGYKGQGKVVA
  gas57M75_30603    (101) DTDAASMANTGPDATQKSASLPPVNTDVHDWVKTKGAWGKGYKGQGKVVA
  gas57M75_30207    (101) DTDAASMANTGPDATQKSASLPPVNTDVHDWVKTKGAWGKGYKGQGKVVA
  gas57M22_20641    (100) DTDAAPMANTGPDATQKSASLPPVNTDVHDWVKTKGAWDKGYKGQGKVVA
  gas57M22_23465    (100) DTDAAPMANTGPDATQKSASLPPVNTDVHDWVKTKGAWDKGYKGQGKVVA
  gas57M3,1_30610   (100) DTDAAPMANTGPDATQKSASLPPVNTDVHDWVKTKGAWDKGYKGQGKVVA
  gas57M3,1_40603   (100) DTDAAPMANTGPDATQKSASLPPVNTDVHDWVKTKGAWDKGYKGQGKVVA
  gas57M3,28_24214  (100) DTDAAPMANTGPDATQKSASLPPVNTDVHDWVKTKGAWDKGYKGQGKVVA
  gas57M3,34_10307  (100) DTDAAPMANTGPDATQKSASLPPVNTDVHDWVKTKGAWDKGYKGQGKVVA
  gas57M4_40427     (100) DTDAAPMANTGPDATQKSASLPPVNTDVHDWVKTKGAWDKGYKGQGKVVA
  gas57M3_2721      (100) DTDAAPMANTGPDATQKSASLPPVNTDVHDWVKTKGAWDKGYKGQGKVVA
  gas57M12_10296    (99)  DTDAAPMANTGPDATQKSASLPPVNTDVHDWVKTKGAWDKGYKGQGKVVA
  gas57M12_10035    (99)  DTDAAPMANTGPDATQKSASLPPVNTDVHDWVKTKGAWDKGYKGQGKVVA
  gas57M12_20069    (99)  DTDAAPMANTGPDATQKSASLPPVNTDVHDWVKTKGAWDKGYKGQGKVVA
  gas57M12_22432    (99)  DTDAAPMANTGPDATQKSASLPPVNTDVHDWVKTKGAWDKGYKGQGKVVA
  gas57M4_40499     (99)  DTDAAPMANTGPDATQKSASLPPVNTDVHDWVKTKGAWDKGYKGQGKVVA
  gas57M6,1_21259   (99)  DTDAAPMANTGPDATQKSASLPPVNTDVHDWVKTKGAWDKGYKGQGKVVA
```

FIG. 10D

```
                                  151                                              200
       gas57M1_SF370       (149)  VIDTGIDPAHQSMRISDVSTAKVKSKEDMLARQKAAGINYGSWINDKVVF
       gas57M1_31075       (149)  VIDTGIDPAHQSMRISDVSTAKVKSKEDMLARQKAAGINYGSWINDKVVF
       gas57M1_31237       (149)  VIDTGIDPAHQSMRISDVSTAKVKSKEDMLARQKAAGINYGSWINDKVVF
        gas57M1_3348       (149)  VIDTGIDPAHQSMRISDVSTAKVKSKEDMLARQKAAGINYGSWINDKVVF
        gas57M2_34585      (149)  VIDTGIDPAHQSMRISDVSTAKVKSKEDMLARQKAAGINYGSWINDKVVF
      gas57M3,1_21398      (149)  VIDTGIDPAHQSMRISDVSTAKVKSKEDMLARQKAAGINYGSWINDKVVF
    gas57M44-61_20839      (149)  VIDTGIDPAHQSMRISDVSTAKVKSKEDMLARQKAAGINYGSWINDKVVF
       gas57M6,31_20022    (148)  VIDTGIDPAHQSMRISDVSTAKVKSKEDMLARQKAAGINYGSWINDKVVF
        gas57M11_20648     (149)  VIDTGIDPAHQSMRISDVSTAKVKSKEDMLARQKAAGINYGSWINDKVVF
        gas57M23_2071      (148)  VIDTGIDPAHQSMRISDVSTAKVKSKEDMLARQKAAGINYGSWINDKVVF
      gas57M18,3_40128     (151)  VIDTGIDPAHQSMRISDVSTAKVKSKEDMLARQKAAGINYGSWINDKVVF
        gas57M4_10092      (151)  VIDTGIDPAHQSMRISDVSTAKVKSKEDMLARQKAAGINYGSWINDKVVF
        gas57M4_30968      (151)  VIDTGIDPAHQSMRISDVSTAKVKSKEDMLARQKAAGINYGSWINDKVVF
       gas57M6,31_22692    (151)  VIDTGIDPAHQSMRISDVSTAKVKSKEDMLARQKAAGINYGSWINDKVVF
      gas57M68,5_22814     (150)  VIDTGIDPAHQSMRISDVSTAKVKSKEDMLARQKAAGINYGSWINDKVVF
        gas57M68_23623     (151)  VIDTGIDPAHQSMRISDVSTAKVKSKEDMLARQKAAGINYGSWINDKVVF
        gas57M2_10064      (149)  VIDTGIDPAHQSMRISDVSTAKVKSKEDMLARQKAAGINYGSWINDKVVF
        gas57M2_10065      (149)  VIDTGIDPAHQSMRISDVSTAKVKSKEDMLARQKAAGINYGSWINDKVVF
        gas57M77_10251     (149)  VIDTGIDPAHQSMRISDVSTAKVKSKEDMLARQKAAGINYGSWINDKVVF
        gas57M77_10527     (149)  VIDTGIDPAHQSMHISDVSTAKVKSKEDMLARQKAAGINYGSWINDKVVF
        gas57M77_20696     (149)  VIDTGIDPAHQSMHISDVSTAKVKSKEDMLARQKAAGINYGSWINDKVVF
        gas57M89_21915     (149)  VIDTGIDPAHQSMRISDVSTAKVKSKEDMLARQKAAGINYGSWINDKVVF
        gas57M89_23717     (149)  VIDTGIDPAHQSMRISDVSTAKVKSKEDMLARQKAAGINYGSWINDKVVF
        gas57M94_10134     (149)  VIDTGIDPAHQSMRISDVSTAKVKSKEDMLARQKAAGINYGSWINDKVVF
        gas57M28_10164     (149)  VIDTGIDPAHQSMRISDVSTAKVKSKEDMLARQKAAGINYGSWINDKVVF
        gas57M28_10218     (149)  VIDTGIDPAHQSMRISDVSTAKVKSKEDMLARQKAAGINYGSWINDKVVF
        gas57M28_10266     (149)  VIDTGIDPAHQSMRISDVSTAKVKSKEDMLARQKAAGINYGSWINDKVVF
        gas57M28_10299     (149)  VIDTGIDPAHQSMRISDVSTAKVKSKEDMLARQKAAGINYGSWINDKVVF
        gas57M28_30176     (149)  VIDTGIDPAHQSMRISDVSTAKVKSKEDMLARQKAAGINYGSWINDKVVF
        gas57M28_30574     (149)  VIDTGIDPAHQSMRISDVSTAKVKSKEDMLARQKAAGTNYGSWINDKVVF
       gas57M6,9_21802     (150)  VIDTGIDPAHQSMRISDVSTAKVKSKEDMLARQKAAGINYGSWINDKVVF
        gas57M75_10012     (151)  VIDTGIDPAHQSMRISDVSTAKVKSKEDMLARQKAAGINYGSWINDKVVF
        gas57M75_20671     (151)  VIDTGIDPAHQSMRISDVSTAKVKSKEDMLARQKAAGINYGSWINDKVVF
        gas57M75_30603     (151)  VIDTGIDPAHQSMRISDVSTAKVKSKEDMLARQKAAGINYGSWINDKVVF
        gas57M75_30207     (151)  VIDTGIDPAHQSMRISDVSTAKVKSKEDMLARQKAAGINYGSWINDKVVF
        gas57M22_20641     (150)  VIDTGIDPAHQSMRISDVSTAKVKSKEDMLARQKAAGINYGSWINDKVVF
        gas57M22_23465     (150)  VIDTGIDPAHQSMRISDVSTAKVKSKEDMLARQKAAGINYGSWINDKVVF
      gas57M3,1_30610      (150)  VIDTGIDPAHQSMRISDVSTAKVKSKEDMLARQKAAGINYGSWINDKVVF
      gas57M3,1_40603      (150)  VIDTGIDPAHQSMRISDVSTAKVKSKEDMLARQKAAGINYGSWINDKVVF
     gas57M3,28_24214      (150)  VIDTGIDPAHQSMRISDVSTAKVKSKEDMLARQKAAGINYGSWINDKVVF
     gas57M3,34_10307      (150)  VIDTGIDPAHQSMRISDVSTAKVKSKEDMLARQKAAGINYGSWINDKVVF
        gas57M4_40427      (150)  VIDTGIDPAHQSMRISDVSTAKVKSKEDMLARQKAAGINYGSWINDKVVF
        gas57M3_2721       (150)  VIDTGIDPAHQSMRISDVSTAKVKSKEDMLARQKAAGINYGSWINDKVVF
        gas57M12_10296     (149)  VIDTGIDPAHQSMRISDVSTAKVKSKEDMLARQKAAGINYGSWINDKVVF
        gas57M12_10035     (149)  VIDTGIDPAHQSMRISDVSTAKVKSKEDMLARQKAAGINYGSWINDKVVF
        gas57M12_20069     (149)  VIDTGIDPAHQSMRISDVSTAKVKSKEDMLARQKAAGINYGSWINDKVVF
        gas57M12_22432     (149)  VIDTGIDPAHQSMRISDVSTAKVKSKEDMLARQKAAGINYCSWINDKVVF
        gas57M4_40499      (149)  VIDTGIDPAHQSMRISDVSTAKVKSKEDMLARQKAAGINYGSWINDKVVF
       gas57M6,1_21259     (149)  VIDTGIDPAHQSMRISDVSTAKVKSKEDMLARQKAAGINYGSWINDKVVF
```

FIG. 10E

```
                        201                                               250
   gas57M1_SF370  (199) AHNYVENSDNIKENQFEDFDEDWENFEFDAEAEPKAIKKHKIYRPQSTQA
   gas57M1_31075  (199) AHNYVENSDNIKENQFEDFDEDWENFEFDAEAEPKAIKKHKIYRPQSTQA
   gas57M1_31237  (199) AHNYVENSDNIKENQFEDFDEDWENFEFDAEAEPKAIKKHKIYRPQSTQA
    gas57M1_3348  (199) AHNYVENSDNIKENQFEDFDEDWENFEFDAEAEPKAIKKHKIYRPQSTQA
   gas57M2_34585  (199) AHNYVENSDNIKENQFEDFDEDWENFEFDAEAEPKAIKKHKIYRPQSTQA
 gas57M3,1_21398  (199) AHNYVENSDNIKENQFEDFDEDWENFEFDADAEPKAIKKHKIYRPQSTQA
gas57M44-61_20839 (199) AHNYVENSDNIKENQFEDFDEDWENFEFDADAEPKAIKKHKIYRPQSTQA
 gas57M6,31_20022 (198) AHNYVENSDNIKENQFEDFDEDWENFEFDADAEPKAIKKHKIYRPQSTQA
   gas57M11_20648 (199) AHNYVENSDNIKENQFGDFDEDWENFEFD--AEPKAIKKNKIYRPQSTQA
    gas57M23_2071 (198) AHNYVENSDNIKENQFGDFDEDWENFEFDAEAEPKAIKKHKIYRPQSTQA
 gas57M18,3_40128 (201) AHNYVENSDNIKENQFGDFDEDWENFEFD--AEPKAIKKNKIYRPQSTQA
   gas57M4_10092  (201) AHNYVENSDNIKENQFGDFDEDWENFEFD--AEPKAIKKNKIYRPQSTQA
   gas57M4_30968  (201) AHNYVENSDNIKENQFGDFDEDWENFEFD--AEPKAIKKNKIYRPQSTQA
 gas57M6,31_22692 (201) AHNYVENSDNIKENQFEDFDEDWENFEFD--AEPKAIKKNKIYRPQSTQA
 gas57M68,5_22814 (200) AHNYVENSDNIKENQFEDFDEDWENFEFD--AEPKAIKKNKIYRPQSTQA
   gas57M68_23623 (201) AHNYVENSDNIKENQFEDFDEDWENFEFD--AEPKAIKKNKIYRPQSTQA
   gas57M2_10064  (199) AHNYVENSDNIKENQFGDFDEDWENFEFD--AEPKAIKKNKIYRPQSTQA
   gas57M2_10065  (199) AHNYVENSDNIKENQFGDFDEDWENFEFD--AEPKAIKKNKIYRPQSTQA
   gas57M77_10251 (199) AHNYVENSDNIKENQFGDFDEDWENFEFD--AEPKAIKKHKIYRPQSTQA
   gas57M77_10527 (199) AHNYVENSDNIKENQFGDFDEDWENFEFD--AEPKAIKKHKIYRPQSTQA
   gas57M77_20696 (199) AHNYVENSDNIKENQFGDFDEDWENFEFD--AEPKAIKKHKIYRPQSTQA
   gas57M89_21915 (199) AHNYVENSDNIKENQFGDFDEDWENFEFDADAEPKAIKKHKIYRPQSTQA
   gas57M89_23717 (199) AHNYVENSDNIKENQFGDFDEDWENFEFDADAEPKAIKKHKIYRPQSTQA
   gas57M94_10134 (199) AHNYVENSDNIKENQFGDFDEDWENFEFD--AEPKAIKKHKIYRPQSTQA
   gas57M28_10164 (199) AHNYVENSDNIKENQFEDFDEDWENFEFD--AEPKAIKKHKIYRPQSTQA
   gas57M28_10218 (199) AHNYVENSDNIKENQFEDFDEDWENFEFD--AEPKAIKKHKIYRPQSTQA
   gas57M28_10266 (199) AHNYVENSDNIKENQFEDFDEDWENFEFD--AEPKAIKKHKIYRPQSTQA
   gas57M28_10299 (199) AHNYVENSDNIKENQFEDFDEDWENFEFD--AEPKATKKHKIYRPQSTQA
   gas57M28_30176 (199) AHNYVENSDNIKENQFEDFDEDWENFEFD--AEPKAIKKHKIYRPQSTQA
   gas57M28_30574 (199) AHNYVENSDNIKENQFEDFDEDWENFEFD--AEPKAIKKHKIYRPQSTQA
  gas57M6,9_21802 (200) AHNYVENSDNIKENQFEDFDEDWENFEFDAEAEPKAIKKHKIYRPQSTQA
   gas57M75_10012 (201) AHNYVENSDNIKENQFEDFDEDWENFEFDADAEPKAIKKHKIYRPQSTQA
   gas57M75_20671 (201) AHNYVENSDNIKENQFEDFDEDWENFEFDADAEPKAIKKHKIYRPQSTQA
   gas57M75_30603 (201) AHNYVENSDNIKENQFEDFDEDWENFEFDADAEPKAIKKHKIYRPQSTQA
   gas57M75_30207 (201) AHNYVENSDNIKENQFEDFDEDWENFEFDADAEPKAIKKHKIYRPQSTQA
   gas57M22_20641 (200) AHNYVENSDNIKENQFEDFDEDWENFEFDAEAEPKAIKKHKIYRPQSTQA
   gas57M22_23465 (200) AHNYVENSDNIKENQFEDFDEDWENFEFDAEAEPKAIKKHKIYRPQSTQA
 gas57M3,1_30610 (200) AHNYVENSDNIKENQFEDFDEDWENFEFDAEAEPKAIKKHKIYRPQSTQA
 gas57M3,1_40603 (200) AHNYVENSDNIKENQFEDFDEDWENFEFDAEAEPKAIKKHKIYRPQSTQA
 gas57M3,28_24214 (200) AHNYVENSDNIKENQFEDFDEDWENFEFDAEAEPKAIKKHKIYRPQSTQA
 gas57M3,34_10307 (200) AHNYVENSDNIKENQFEDFDEDWENFEFDAEAEPKAIKKHKIYRPQSTQA
   gas57M4_40427 (200) AHNYVENSDNIKENQFEDFDEDWENFEFDAEAEPKAIKKHKIYRPQSTQA
    gas57M3_2721 (200) AHNYVENSDNIKENQFEDFDEDWENFEFDAEAEPKAIKKHKIYRPQSTQA
   gas57M12_10296 (199) AHNYVENSDNIKENQFEDFDEDWENFEFDAEAEPKAIKKHKIYRPQSTQA
   gas57M12_10035 (199) AHNYVENSDNIKENQFEDFDEDWENFEFDAEAEPKAIKKHKIYRPQSTQA
   gas57M12_20069 (199) AHNYVENSDNIKENQFEDFDEDWENFEFDAEAEPKAIKKHKIYRPQSTQA
   gas57M12_22432 (199) AHNYVENSDNIKENQFEDFDEDWENFEFDAEAEPKAIKKHKIYRPQSTQA
   gas57M4_40499 (199) AHNYVENSDNIKENQFEDFDEDWENFEFDAEAEPKAIKKHKIYRPQSTQA
 gas57M6,1_21259 (199) AHNYVENSDNIKENQFEDFDEDWENFEFDAEAEPKAIKKHKIYRPQSTQA
```

FIG. 10F

```
                      251                                              300
gas57M1_SF370    (249) PKETVIKTEETDGSHDIDWTQTDDDTKYESHGMHVTGIVAGNSKEAAATG
gas57M1_31075    (249) PKETVIKTEETDGSHDIDWTQTDDDTKYESHGMHVTGIVAGNSKEAAATG
gas57M1_31237    (249) PKETVIKTEETDGSHDIDWTQTDDDTKYESHGMHVTGIVAGNSKEAAATG
gas57M1_3348     (249) PKETVIKTEETDGSHDIDWTQTDDDTKYESHGMHVTGIVAGNSKEAAATG
gas57M2_34585    (249) PKETVIKTEETDGSHDIDWTQTDDDTKYESHGMHVTGIVAGNSKEAAATG
gas57M3,1_21398  (249) PKETVIKTEETDGSHDIDWTQTDDDTKYESHGMHVTGIVAGNSKEAAATG
gas57M44-61_20839 (249) PKETVIKTEETDGSHDIDWTQTDDDTKYESHGMHVTGIVAGNSKEAAATG
gas57M6,31_20022 (248) PKETVIKTEETDGSHDIDWTQTDDDTKYESHGMHVTGIVAGNSKEAAATG
gas57M11_20648   (247) PKETVIKTEETDGSHDIDWTQTDDETKYESHGMHVTGIVAGNSKEAAATG
gas57M23_2071    (248) PKETVIKTEETDGSHDIDWTQTDDDTKYESHGMHVTGIVAGNSKEAAATG
gas57M18,3_40128 (249) PKETVIKTEETDGSHDIDWTQTDDDTKYESHGMHVTGIVAGNSKEAAATG
gas57M4_10092    (249) PKETVIKTEETDGSHDIDWTQTDDDTKYESHGMHVTGIVAGNSKEAAATG
gas57M4_30968    (249) PKETVIKTEETDGSHDIDWTQTDDDTKYESHGMHVTGIVAGNSKEAAATG
gas57M6,31_22692 (249) PKETVIKTEETDGSHDIDWTQTDDDTKYESHGMHVTGIVAGNSKEAAATG
gas57M68,5_22814 (248) PKETVIKTEETDGSHDIDWTQTDDETKYESHGMHVTGIVAGNSKEAAATG
gas57M68_23623   (249) PKETVIKTEETDGSHDIDWTQTDDETKYESHGMHVTGIVAGNSKEAAATG
gas57M2_10064    (247) PKETVIKTEETDGSHDIDWTQTDDETKYESHGMHVTGIVAGNSKEAAATG
gas57M2_10065    (247) PKETVIKTEETDGSHDIDWTQTDDETKYESHGMHVTGIVAGNSKEAAATG
gas57M77_10251   (247) PKETVIKTEETDGSHDIDWTQTDDETKYESHGMHVTGIVAGNSKEAAATG
gas57M77_10527   (247) PKETVIKTEETDGSHDIDWTQTDDETKYESHGMHVTGIVAGNSKEAAATG
gas57M77_20696   (247) PKETVIKTEETDGSHDIDWTQTDDETKYESHGMHVTGIVAGNSKEAAATG
gas57M89_21915   (249) PKETVIKTEETDGSHDIDWTQTDDETKYESHGMHVTGIVAGNSKEAAATG
gas57M89_23717   (249) PKETVIKTEETDGSHDIDWTQTDDETKYESHGMHVTGIVAGNSKEAAATG
gas57M94_10134   (247) PKETVIKTEETDGSHDIDWTQTDDETKYESHGMHVTGIVAGNSKEAAATG
gas57M28_10164   (247) PKETVIKTEETDGSHDIDWTQTDDDTKYESHGMHVTGIVAGNSKEAAATG
gas57M28_10218   (247) PKETVIKTEETDGSHDIDWTQTDDDTKYESHGMHVTGIVAGNSKEAAATG
gas57M28_10266   (247) PKETVIKTEETDGSHDIDWTQTDDDTKYESHGMHVTGIVAGNSKEAAATG
gas57M28_10299   (247) PKETVIKTEETDGSHDIDWTQTDDDTKYESHGMHVTGIVAGNSKEAAATG
gas57M28_30176   (247) PKETVIKTEETDGSHDIDWTQTDDDTKYESHGMHVTGIVAGNSKEAAATG
gas57M28_30574   (247) PKETVIKTEETDGSHDIDWTQTDDDTKYESHGMHVTGIVAGNSKEAAATG
gas57M6,9_21802  (250) PKETVIKTEETDGSHDIDWTQTDDDTKYESHGMHVTGIVAGNSKEAAATG
gas57M75_10012   (251) PKETVIKTEETDGSHDIDWTQTDDDTKYESHGMHVTGIVAGNSKEAAATG
gas57M75_20671   (251) PKETVIKTEETDGSHDIDWTQTDDDTKYESHGMHVTGIVAGNSKEAAATG
gas57M75_30603   (251) PKETVIKTEETDGSHDIDWTQTDDDTKYESHGMHVTGIVAGNSKEAAATG
gas57M75_30207   (251) PKETVIKTEETDGSHDIDWTQTDDDTKYESHGMHVTGIVAGNSKEAAATG
gas57M22_20641   (250) PKETVIKTEETDGSHDIDWTQTDDDTKYESHGMHVTGIVAGNSKEAAATG
gas57M22_23465   (250) PKETVIKTEETDGSHDIDWTQTDDDTKYESHGMHVTGIVAGNSKEAAATG
gas57M3,1_30610  (250) PKETVIKTEETDGSHDIDWTQTDDDTKYESHGMHVTGIVAGNSKEAAATG
gas57M3,1_40603  (250) PKETVIKTEETDGSHDIDWTQTDDDTKYESHGMHVTGIVAGNSKEAAATG
gas57M3,28_24214 (250) PKETVIKTEETDGSHDIDWTQTDDDTKYESHGMHVTGIVAGNSKEAAATG
gas57M3,34_10307 (250) PKETVIKTEETDGSHDIDWTQTDDDTKYESHGMHVTGIVAGNSKEAAATG
gas57M4_40427    (250) PKETVIKTEETDGSHDIDWTQTDDDTKYESHGMHVTGIVAGNSKEAAATG
gas57M3_2721     (250) PKETVIKTEETDGSHDIDWTQTDDDTKYESHGMHVTGIVAGNSKEAAATG
gas57M12_10296   (249) PKETVIKTEETDGSHDIDWTQTDDDTKYESHGMHVTGIVAGNSKEAAATG
gas57M12_10035   (249) PKETVIKTEETDGSHDIDWTQTDDDTKYESHGMHVTGIVAGNSKEAAATG
gas57M12_20069   (249) PKETVIKTEETDGSHDIDWTQTDDDTKYESHGMHVTGIVAGNSKEAAATG
gas57M12_22432   (249) PKETVIKTEETDGSHDIDWTQTDDDTKYESHGMHVTGIVAGNSKEAAATG
gas57M4_40499    (249) PKETVIKTEETDGSHDIDWTQTDDDTKYESHGMHVTGIVAGNSKEAAATG
gas57M6,1_21259  (249) PKETVIKTEETDGSHDIDWTQTDDDTKYESHGMHVTGIVAGNSKEAAATG
```

FIG. 10G

```
                            301                                                   350
     gas57M1_SF370    (299) ERFLGIAPEAQVMFMRVFANDIMGSAESLFIKAIEDAVALGADVINLSLG
     gas57M1_31075   (299) ERFLGIAPEAQVMFMRVFANDIMGSAESLFIKAIEDAVALGADVINLSLG
     gas57M1_31237   (299) ERFLGIAPEAQVMFMRVFANDIMGSAESLFIKAIEDAVALGADVINLSLG
      gas57M1_3348   (299) ERFLGIAPEAQVMFMRVFANDIMGSAESLFIKAIEDAVALGADVINLSLG
     gas57M2_34585   (299) ERFLGIAPEAQVMFMRVFANDIMGSAESLFIKAIEDAVALGADVINLSLG
    gas57M3,1_21398  (299) ERFLGIAPEAQVMFMRVFANDVMGSAESLFIKAIEDAVALGADVINLSLG
   gas57M44-61_20839 (299) ERFLGIAPEAQVMFMRVFANDVMGSAESLFIKAIEDAVALGADVINLSLG
    gas57M6,31_20022 (298) ERFLGIAPEAQVMFMRVFANDVMGSAESLFIKAIEDAVALGADVINLSLG
     gas57M11_20648  (297) ERFLGIAPEAQVMFMRVFANDVMGSAESLFIKAIEDAVALGADVINLSLG
      gas57M23_2071  (298) ERFLGIAPEAQVMFMRVFANDVMGSAESLFIKAIEDAVALGADVINLSLG
   gas57M18,3_40128  (299) ERFLGIAPEAQVMFMRVFANDVMGSAESLFIKAIEDAVALGADVINLSLG
     gas57M4_10092   (299) ERFLGIAPEAQVMFMRVFANDVMGSAESLFIKAIEDAVALGADVINLSLG
     gas57M4_30968   (299) ERFLGIAPEAQVMFMRVFANDVMGSAESLFIKAIEDAVALGADVINLSLG
    gas57M6,31_22692 (299) ERFLGIAPEAQVMFMRVFANDVMGSAESLFIKAIEDAVALGADVINLSLG
    gas57M68,5_22814 (298) ERFLGIAPEAQVMFMRVFANDVMGSAESLFIKAIEDAVALGADVINLSLG
     gas57M68_23623  (299) ERFLGIAPEAQVMFMRVFANDVMGSAESLFIKAIEDAVALGADVINLSLG
     gas57M2_10064   (297) ERFLGIAPEAQVMFMRVFANDVMGSAESLFIKAIEDAVALGADVINLSLG
     gas57M2_10065   (297) ERFLGIAPEAQVMFMRVFANDVMGSAESLFIKAIEDAVALGADVINLSLG
     gas57M77_10251  (297) ERFLGIAPEAQVMFMRVFANDVMGSAESLFIKAIEDAVALGADVINLSLG
     gas57M77_10527  (297) ERFLGIAPEAQVMFMRVFANDVMGSAESLFIKAIEDAVALGADVINLSLG
     gas57M77_20696  (297) ERFLGIAPEAQVMFMRVFANDVMGSAESLFIKAIEDAVALGADVINLSLG
     gas57M89_21915  (299) ERFLGIAPEAQVMFMRVFANDVMGSAESLFIKAIEDAVALGADVINLSLG
     gas57M89_23717  (299) ERFLGIAPEAQVMFMRVFANDVMGSAESLFIKAIEDAVALGADVINLSLG
     gas57M94_10134  (297) ERFLGIAPEAQVMFMRVFANDVMGSAESLFIKAIEDAVALGADVINLSLG
     gas57M28_10164  (297) ERFLGIAPETQVMFMRVFANDVMGSAESLFIKAIEDAVALGADVINLSLG
     gas57M28_10218  (297) ERFLGIAPETQVMFMRVFANDVMGSAESLFIKAIEDAVALGADVINLSLG
     gas57M28_10266  (297) ERFLGIAPETQVMFMRVFANDVMGSAESLFIKAIEDAVALGADVINLSLG
     gas57M28_10299  (297) ERFLGIAPETQVMFMRVFANDVMGSAESLFIKAIEDAVALGADVINLSLG
     gas57M28_30176  (297) ERFLGIAPETQVMFMRVFANDVMGSAESLFIKAIEDAVALGADVINLSLG
     gas57M28_30574  (297) ERFLGIAPETQVMFMRVFANDVMGSAESLFIKAIEDAVALGADVINLSLG
    gas57M6,9_21802  (300) ERFLGIAPEAQVMFMRVFANDVMGSAESLFIKAIEDAVALGADVINLSLG
     gas57M75_10012  (301) ERFLGIAPEAQVMFMRVFANDVMGSAESLFIKAIEDAVALGADVINLSLG
     gas57M75_20671  (301) ERFLGIAPEAQVMFMRVFANDVMGSAESLFIKAIEDAVALGADVINLSLG
     gas57M75_30603  (301) ERFLGIAPEAQVMFMRVFANDVMGSAESLFIKAIEDAVALGADVINLSLG
     gas57M75_30207  (301) ERFLGIAPEAQVMFMRVFANDVMGSAESLFIKAIEDAVALGADVINLSLG
     gas57M22_20641  (300) ERFLGIAPEAQVMFMRVFANDVMGSAESLFIKAIEDAVALGADVINLSLG
     gas57M22_23465  (300) ERFLGIAPEAQVMFMRVFANDVMGSAESLFIKAIEDAVALGADVINLSLG
    gas57M3,1_30610  (300) ERFLGIAPEAQVMFMRVFANDVMGSAESLFIKAIEDAVALGADVINLSLG
    gas57M3,1_40603  (300) ERFLGIAPEAQVMFMRVFANDVMGSAESLFIKAIEDAVALGADVINLSLG
   gas57M3,28_24214  (300) ERFLGIAPEAQVMFMRVFANDVMGSAESLFIKAIEDAVALGADVINLSLG
    gas57M3,34_10307 (300) ERFLGIAPEAQVMFMRVFANDVMGSAESLFIKAIEDAVALGADVINLSLG
     gas57M4_40427   (300) ERFLGIAPEAQVMFMRVFANDVMGSAESLFIKAIEDAVALGADVINLSLG
      gas57M3_2721   (300) ERFLGIAPEAQVMFMRVFANDVMGSAESLFIKAIEDAVALGADVINLSLG
     gas57M12_10296  (299) ERFLGIAPEAQVMFMRVFANDVMGSAESLFIKAIEDAVALGADVINLSLG
     gas57M12_10035  (299) ERFLGIAPEAQVMFMRVFANDVMGSAESLFIKAIEDAVALGADVINLSLG
     gas57M12_20069  (299) ERFLGIAPEAQVMFMRVFANDVMGSAESLFIKAIEDAVALGADVINLSLG
     gas57M12_22432  (299) ERFLGIAPEAQVMFMRVFANDVMGSAESLFIKAIEDAVALGADVINLSLG
     gas57M4_40499   (299) ERFLGIAPEAQVMFMRVFANDVMGSAESLFIKAIEDAVALGADVINLSLG
    gas57M6,1_21259  (299) ERFLGIAPEAQVMFMRVFANDVMGSAESLFIKAIEDAVALGADVINLSLG
```

FIG. 10H

```
                          351                                            400
   gas57M1_SF370    (349) TANGAQLSGSKPLMEAIEKAKKAGVSVVVAAGNERVYGSDHDDPLATNPD
   gas57M1_31075   (349) TANGAQLSGSKPLMEAIEKAKKAGVSVVVAAGNERVYGSDHDDPLATNPD
   gas57M1_31237   (349) TANGAQLSGSKPLMEAIEKAKKAGVSVVVAAGNERVYGSDHDDPLATNPD
    gas57M1_3348   (349) TANGAQLSGSKPLMEAIEKAKKAGVSVVVAAGNERVYGSDHDDPLATNPD
   gas57M2_34585   (349) TANGAQLSGSKPLMEAIEKAKKAGVSVVVAAGNERVYGSDHDDPLATNPD
  gas57M3,1_21398  (349) TANGAQLSGSKPLMEAIEKAKKAGVSVVVAAGNERVYGSDHDDPLATNPD
  gas57M44-61_20839 (349) TANGAQLSGSKPLMEAIEKAKKAGVSVVVAAGNERVYGSDHDDPLATNPD
  gas57M6,31_20022 (348) TANGAQLSGSKPLMEAIEKAKKAGVSVVVAAGNERVYGSDHDDPLATNPD
   gas57M11_20648  (347) TANGAQLSGSKPLMEAIEKAKKAGVSVVVAAGNERVYGSDHDDPLATNPD
    gas57M23_2071  (348) TANGAQLSGSKPLMEAIEKAKKAGVSVVVAAGNERVYGSDHDDPLATNPD
  gas57M18,3_40128 (349) TANGAQLSGSKPLMEAIEKAKKAGVSVVVAAGNERVYGSDHDDPLATNPD
    gas57M4_10092  (349) TANGAQLSGSKPLMEAIEKAKKAGVSVVVAAGNERVYGSDHDDPLATNPD
    gas57M4_30968  (349) TANGAQLSGSKPLMEAIEKAKKAGVSVVVAAGNERVYGSDHDDPLATNPD
  gas57M6,31_22692 (349) TANGAQLSGSKPLMEAIEKAKKAGVSVVVAAGNERVYGSDHDDPLATNPD
  gas57M68,5_22814 (348) TANGAQLSGSKPLMEAIEKAKKAGVSVVVAAGNERVYGSDHDDPLATNPD
   gas57M68_23623  (349) TANGAQLSGSKPLMEAIEKAKKAGVSVVVAAGNERVYGSDHDDPLATNPD
    gas57M2_10064  (347) TANGAQLSGSKPLIEAIEKAKKAGVSVVVAAGNERVYGSDHDDPLATNPD
    gas57M2_10065  (347) TANGAQLSGSKPLIEAIEKAKKAGVSVVVAAGNERVYGSDHDDPLATNPD
   gas57M77_10251  (347) TANGAQLSGSKPLMEAIEKAKKAGVSVVVAAGNERVYGSDHDDPLATNPD
   gas57M77_10527  (347) TANGAQLSGSKPLMEAIEKAKKAGVSVVVAAGNERVYGSDHDDPLATNPD
   gas57M77_20696  (347) TANGAQLSGSKPLMEAIEKAKKAGVSVVVAAGNERVYGFDHDDPLATNPD
   gas57M89_21915  (349) TANGAQLSGSKPLMEAIEKAKKAGVSVVVAAGNERVYGSDHDDPLATNPD
   gas57M89_23717  (349) TANGAQLSGSKPLMEAIEKAKKAGVSVVVAAGNERVYGSDHDDPLATNPD
   gas57M94_10134  (347) TANGAQLSGSKPLMEAIEKAKKAGVSVVVAAGNERVYGSDHDDPLATNPD
   gas57M28_10164  (347) TANGAQLSGSKPLMEAIEKAKKAGVSVVVAAGNERVYGSDHDDPLATNPD
   gas57M28_10218  (347) TANGAQLSGSKPLMEAIEKAKKAGVSVVVAAGNERVYGSDHDDPLATNPD
   gas57M28_10266  (347) TANGAQLSGSKPLMEAIEKAKKAGVSVVVAAGNERVYGSDHDDPLATNPD
   gas57M28_10299  (347) TANGAQLSGSKPLMEAIEKAKKAGVSVVVAAGNERVYGSDHDDPLATNPD
   gas57M28_30176  (347) TANGAQLSGSKPLMEAIEKAKKAGVSVVVAAGNERVYGSDHDDPLATNPD
   gas57M28_30574  (347) TANGAQLSGSKPLMEAIEKAKKAGVSVVVAAGNERVYGSDHDDPLATNPD
  gas57M6,9_21802  (350) TANGAQLSGSKPLMEAIEKAKKAGVSVVVAAGNERVYGSDHDDPLATNPD
   gas57M75_10012  (351) TANGAQLSGSKPLMEAIEKAKKAGVSVVVAAGNERVYGSDHDDPLATNPD
   gas57M75_20671  (351) TANGAQLSGSKPLMEAIEKAKKAGVSVVVAAGNERVYGSDHDDPLATNPD
   gas57M75_30603  (351) TANGAQLSGSKPLMEAIEKAKKAGVSVVVAAGNERVYGSDHDDPLATNPD
   gas57M75_30207  (351) TANGAQLSGSKPLMEAIEKAKKAGVSVVVAAGNERVYGSDHDDPLATNPD
   gas57M22_20641  (350) TANGAQLSGSKPLMEAIEKAKKAGVSVVVAAGNERVYGSDHDDPLATNPD
   gas57M22_23465  (350) TANGAQLSGSKPLMEAIEKAKKAGVSVVVAAGNERVYGSDHDDPLATNPD
  gas57M3,1_30610  (350) TANGAQLSGSKPLMEAIEKAKKAGVSVVVAAGNERVYGSDHDDPLATNPD
  gas57M3,1_40603  (350) TANGAQLSGSKPLMEAIEKAKKAGVSVVVAAGNERVYGSDHDDPLATNPD
  gas57M3,28_24214 (350) TANGAQLSGSKPLMEAIEKAKKAGVSVVVAAGNERVYGSDHDDPLATNPD
  gas57M3,34_10307 (350) TANGAQLSGSKPLMEAIEKAKKAGVSVVVAAGNERVYGSDHDDPLATNPD
    gas57M4_40427  (350) TANGAQLSGSKPLMEAIEKAKKAGVSVVVAAGNERVYGSDHDDPLATNPD
    gas57M3_2721   (350) TANGAQLSGSKPLMEAIEKAKKAGVSVVVAAGNERVYGSDHDDPLATNPD
   gas57M12_10296  (349) TANGAQLSGSKPLMEAIEKAKKAGVSVVVAAGNERVYGSDHDDPLATNPD
   gas57M12_10035  (349) TANGAQLSGSKPLMEAIEKAKKAGVSVVVAAGNERVYGSDHDDPLATNPD
   gas57M12_20069  (349) TANGAQLSGSKPLMEAIEKAKKAGVSVVVAAGNERVYGSDHDDPLATNPD
   gas57M12_22432  (349) TANGAQLSGSKPLMEAIEKAKKAGVSVVVAAGNERVYGSDHDDPLATNPD
    gas57M4_40499  (349) TANGAQLSGSKPLMEAIEKAKKAGVSVVVAAGNERVYGSDHDDPLATNPD
  gas57M6,1_21259  (349) TANGAQLSGSKPLMEAIEKAKKAGVSVVVAAGNERVYGSDHDDPLATNPD
```

FIG. 10I

```
                          401                                                450
   gas57M1_SF370    (399) YGLVGSPSTGRTPTSVAAINSKWVIQRLMTVKELENRADLNHGKAIYSES
    gas57M1_31075   (399) YGLVGSPSTGRTPTSVAAINSKWVIQRLMTVKELENRADLNHGKAIYSES
    gas57M1_31237   (399) YGLVGSPSTGRTPTSVAAINSKWVIQRLMTVKELENRADLNHGKAIYSES
     gas57M1_3348   (399) YGLVGSPSTGRTPTSVAAINSKWVIQRLMTVKELENRADLNHGKAIYSES
    gas57M2_34585   (399) YGLVGSPSTGRTPTSVAAINSKWVIQRLMTVKELENRADLNHGKAIYSES
   gas57M3,1_21398  (399) YGLVGSPSTGRTPTSVAAINSKWVIQRLMTVKELENRADLNHGKAIYSES
  gas57M44-61_20839 (399) YGLVGSPSTGRTPTSVAAINSKWVIQRLMTVKELENRADLNHGKAIYSES
   gas57M6,31_20022 (398) YGLVGSPSTGRTPTSVAAINSKWVIQRLMTVKELENRADLNHGKAIYSES
    gas57M11_20648  (397) YGLVGSPSTGRTPTSVAAINSKWVIQRLMTVKELENRADLNHGKAIYSES
     gas57M23_2071  (398) YGLVGSPSTGRTPTSVAAINSKWVIQRLMTVKELENRADLNHGKAIYSES
  gas57M18,3_40128  (399) YGLVGSPSTGRTPTSVAAINSKWVIQRLMTAKELENRADLNHGKAIYSES
    gas57M4_10092   (399) YGLVGSPSTGRTPTSVAAINSKWVIQRLMTVKELENRADLNHGKAIYSES
    gas57M4_30968   (399) YGLVGSPSTGRTPTSVAAINSKWVIQRLMTAKELENRADLNHGKAIYSES
   gas57M6,31_22692 (399) YGLVGSPSTGRTPTSVAAINSKWVIQRLMTAKELENRADLNHGKAIYSES
   gas57M68,5_22814 (398) YGLVGSPSTGRTPTSVAAINSKWVIQRLMTVKELENRADLNHGKAIYSES
    gas57M68_23623  (399) YGLVGSPSTGRTPTSVAAINSKWVIQRLMTVKELENRADLNHGKAIYSES
    gas57M2_10064   (397) YGLVGSPSTGRTPTSVAAINSKWVIQRLMTVKELENRADLNHGKAIYSES
    gas57M2_10065   (397) YGLVGSPSTGRTPTSVAAINSKWVIQRLMTVKELENRADLNHGKAIYSES
    gas57M77_10251  (397) YGLVGSPSTGRTPTSVAAINSKWVIQRLMTVKELENRADLNHGKAIYSES
    gas57M77_10527  (397) YGLVGSPSTGRTPTSVAAINSKWVIQRLMTVKELENRADLNHGKAIYSES
    gas57M77_20696  (397) YGLVGSPSTGRTPTSVAAINSKWVIQRLMTVKELENRADLNHGKAIYSES
    gas57M89_21915  (399) YGLVGSPSTGRTPTSVAAINSKWVIQRLMTVKELENRADLNHGKAIYSES
    gas57M89_23717  (399) YGLVGSPSTGRTPTSVAAINSKWVIQRLMTVKELENRADLNHGKAIYSES
    gas57M94_10134  (397) YGLVGSPSTGRTPTSVAAINSKWVIQRLMTVKELESRADLNHGKAIYSES
    gas57M28_10164  (397) YGLVGSPSTGRTPTSVAAINSKWVIQRLMTVKELENRADLNHGKAIYSES
    gas57M28_10218  (397) YGLVGSPSTGRTPTSVAAINSKWVIQRLMTVKELENRADLNHGKAIYSES
    gas57M28_10266  (397) YGLVGSPSTGRTPTSVAAINSKWVIQRLMTVKELENRADLNHGKAIYSES
    gas57M28_10299  (397) YGLVGSPSTGRTPTSVAAINSKWVIQRLMTVKELENRADLNHGKAIYSES
    gas57M28_30176  (397) YGLVGSPSTGRTPTSVAAINSKWVIQRLMTVKELENRADLNHGKAIYSES
    gas57M28_30574  (397) YGLVGSPSTGRTPTSVAAINSKWVIQRLMTVKELENRADLNHGKAIYSES
    gas57M6,9_21802 (400) YGLVGSPSTGRTPTSVAAINSKWVIQRLMTVKELENRADLNHGKAIYSES
    gas57M75_10012  (401) YGLVGSPSTGRTPTSVAAINSKWVIQRLMTVKELENRADLNHGKAIYSES
    gas57M75_20671  (401) YGLVGSPSTGRTPTSVAAINSKWVIQRLMTVKELENRADLNHGKAIYSES
    gas57M75_30603  (401) YGLVGSPSTGRTPTSVAAINSKWVIQRLMTVKELENRADLNHGKAIYSES
    gas57M75_30207  (401) YGLVGSPSTGRTPTSVAAINSKWVIQRLMTVKELENRADLNHGKAIYSES
    gas57M22_20641  (400) YGLVGSPSTGRTPTSVAAINSKWVIQRLMTVKELENRADLNHGKAIYSES
    gas57M22_23465  (400) YGLVGSPSTGRTPTSVAAINSKWVIQRLMTVKELENRADLNHGKAIYSES
   gas57M3,1_30610  (400) YGLVGSPSTGRTPTSVAAINSKWVIQRLMTVKELENRADLNHGKAIYSES
   gas57M3,1_40603  (400) YGLVGSPSTGRTPTSVAAINSKWVIQRLMTVKELENRADLNHGKAIYSES
   gas57M3,28_24214 (400) YGLVGSPSTGRTPTSVAAINSKWVIQRLMTVKELENRADLNHGKAIYSES
   gas57M3,34_10307 (400) YGLVGSPSTGRTPTSVAAINSKWVIQRLMTVKELENRADLNHGKAIYSES
    gas57M4_40427   (400) YGLVGSPSTGRTPTSVAAINSKWVIQRLMTVKELENRADLNHGKAIYSES
     gas57M3_2721   (400) YGLVGSPSTGRTPTSVAAINSKWVIQRLMTVKELENRADLNHGKAIYSES
    gas57M12_10296  (399) YGLVGSPSTGRTPTSVAAINSKWVIQRLMTVKELENRADLNHGKAIYSES
    gas57M12_10035  (399) YGLVGSPSTGRTPTSVAAINSKWVIQRLMTVKELENRADLNHGKAIYSES
    gas57M12_20069  (399) YGLVGSPSTGRTPTSVAAINSKWVIQRLMTVKELENRADLNHGKAIYSES
    gas57M12_22432  (399) YGLVGSPSTGRTPTSVAAINSKWVIQRLMTVKELENRADLNHGKAIYSES
    gas57M4_40499   (399) YGLVGSPSTGRTPTSVAAINSKWVIQRLMTVKELENRADLNHGKAIYSES
   gas57M6,1_21259  (399) YGLVGSPSTGRTPTSVAAINSKWVIQRLMTVKELENRADLNHGKAIYSES
```

FIG. 10J

```
                            451                                              500
   gas57M1_SF370    (449) VDFKDIKDSLGYDKSHQFAYVKESTDAGYNAQDVKGKIALIERDPNKTYD
   gas57M1_31075   (449) VDFKDIKDSLGYDKSHQFAYVKESTDAGYNAQDVKGKIALIERDPNKTYD
   gas57M1_31237   (449) VDFKDIKDSLGYDKSHQFAYVKESTDAGYNAQDVKGKIALIERDPNKTYD
    gas57M1_3348   (449) VDFKDIKDSLGYDKSHQFAYVKESTDAGYNAQDVKGKIALIERDPNKTYD
   gas57M2_34585   (449) VDFKDIKDSLGYDKSHQFAYVKESTDAGYNAQDVKGKIALIERDPNKTYD
  gas57M3,1_21398  (449) VDFKNIKDSLGYDKSHQFAYVKESTDAGYKAQDVKGKIALIERDPNKTYD
 gas57M44-61_20839 (449) VDFKDIKDSLGYDKSHQFAYVKESTDAGYKAQDVKDKIALIERDPNKTYD
  gas57M6,31_20022 (448) VDFKNIKDSLGYDKSHQFAYVKESTDAGYKAQDVKDKIALIERDPNKTYD
   gas57M11_20648  (447) VDFKNIKDSLGYDKSHQFAYVKESTDAGYNAQDVKGKIALIERDPNKTYD
    gas57M23_2071  (448) VDFKNIKDSLGYDKSHQFAYVKESTDAGYKAQDVKGKIALIERDPNKTYD
  gas57M18,3_40128 (449) VDFKNIKDSLGYDKSHQFAYVKESTDAGYKAQDVKDKIALIERDPNKTYD
   gas57M4_10092   (449) VDFKNIKDSLGYDKSHQFAYVKESTDAGYKAQDVKDKIALIERDPNKTYD
   gas57M4_30968   (449) VDFKNIKDSLGYDKSHQFAYVKESTDAGYKAQDVKDKIALIERDPNKTYD
  gas57M6,31_22692 (449) VDFKNIKDSLGYDKSHQFAYVKESTDAGYKAQDVKDKIALIERDPNKTYD
  gas57M68,5_22814 (448) VDFKDIKDSLGYDKSHQFAYVKESTDAGYNAQDVKGKIALIERDPNKTYD
   gas57M68_23623  (449) VDFKDIKDSLGYDKSHQFAYVKESTDAGYNAQDVKGKIALIERDPNKTYD
   gas57M2_10064   (447) VDFKDIKDSLGYDKSHQFAYVKESTDAGYKAQDVKGKIALIERDPNKTYD
   gas57M2_10065   (447) VDFKDIKDSLGYDKSHQFAYVKESTDAGYKAQDVKGKIALIERDPNKTYD
   gas57M77_10251  (447) VDFKDIKDSLGYDKSHQFAYVKESTDAGYNAQDVKGKIALIERDPNKTYD
   gas57M77_10527  (447) VDFKDIKDSLGYDKSHQFAYVKESTDAGYNAQDVKGKIALIERDPNKTYD
   gas57M77_20696  (447) VDFKDIKDSLGYDKSHQFAYVKESTDAGYNAQDVKGKIALIERDPNKTYD
   gas57M89_21915  (449) VDFKDIKDSLGYDKSHQFAYVKESTDAGYNAQDVKGKIALIERDPNKTYD
   gas57M89_23717  (449) VDFKDIKDSLGYDKSHQFAYVKESTDAGYNAQDVKGKIALIERDPNKTYD
   gas57M94_10134  (447) VDFKDIKDSLGYDKSHQFAYVKESTDAGYKAQDVKGKIALIERDPNKTYD
   gas57M28_10164  (447) VDFKDIKDSLGYDKSHQFAYVKESTDAGYNAQDVKGKIALIERDPNKTYD
   gas57M28_10218  (447) VDFKDIKDSLGYDKSHQFAYVKESTDAGYNAQDVKGKIALIERDPNKTYD
   gas57M28_10266  (447) VDFKDIKDSLGYDKSHQFAYVKESTDAGYNAQDVKGKIALIERDPNKTYD
   gas57M28_10299  (447) VDFKDIKDSLGYDKSHQFAYVKESTDAGYNAQDVKGKIALIERDPNKTYD
   gas57M28_30176  (447) VDFKDIKDSLGYDKSHQFAYVKESTDAGYNAQDVKGKIALIERDPNKTYD
   gas57M28_30574  (447) VDFKDIKDSLGYDKSHQFAYVKESTDAGYNAQDVKGKIALIERDPNKTYD
   gas57M6,9_21802 (450) VDFKNIKDSLGYDKSHQFAYVKESTDAGYNAQDVKGKIALIERDPNKTYD
   gas57M75_10012  (451) VDFKNIKDSLGYDKSHQFAYVKESTDAGYNAQDVKGKIALIERDPNKTYD
   gas57M75_20671  (451) VDFKNIKDSLGYDKSHQFAYVKESTDAGYNAQDVKGKIALIERDPNKTYD
   gas57M75_30603  (451) VDFKNIKDSLGYDKSHQFAYVKESTDAGYNAQDVKGKIALIERDPNKTYD
   gas57M75_30207  (451) VDFKNIKDSLGYDKSHQFAYVKESTDAGYNAQDVKGKIALIERDPNKTYD
   gas57M22_20641  (450) VDFKNIKDSLGYDKTHQFAYVKESTDAGYKAQDVKGKIALIERDPNKTYD
   gas57M22_23465  (450) VDFKNIKDSLGYDKTHQFAYVKESTDAGYKAQDVKGKIALIERDPNKTYD
  gas57M3,1_30610  (450) VDFKNIKDSLGYDKSHQFAYVKESTDAGYNAQDVKGKIALIERDPNKTYD
  gas57M3,1_40603  (450) VDFKNIKDSLGYDKSHQFAYVKESTDAGYNAQDVKGKIALIERDPNKTYD
 gas57M3,28_24214  (450) VDFKNIKDSLGYDKSHQFAYVKESTDAGYNAQDVKGKIALIERDPNKTYD
 gas57M3,34_10307  (450) VDFKNIKDSLGYDKSHQFAYVKESTDAGYNAQDVKGKIALIERDPNKTYD
   gas57M4_40427   (450) VDFKNIKDSLGYDKSHQFAYVKESTDAGYNAQDVKGKIALIERDPNKTYD
    gas57M3_2721   (450) VDFKNIKDSLGYDKSHQFAYVKESTDAGYNAQDVKGKIALIERDPNKTYD
   gas57M12_10296  (449) VDFKNIKDSLGYDKSHQFAYVKESTDAGYNAQNVKGKIALIERDPNKTYD
   gas57M12_10035  (449) VDFKNIKDSLGYDKSHQFAYVKESTDAGYNAQNVKGKIALIERDPNKTYD
   gas57M12_20069  (449) VDFKNIKDSLGYDKSHQFAYVKESTDAGYNAQNVKGKIALIERDPNKTYD
   gas57M12_22432  (449) VDFKNIKDSLGYDKSHQFAYVKESTDAGYNAQNVKGKIALIERDPNKTYD
   gas57M4_40499   (449) VDFKNIKDSLGYDKSHQFAYVKESTDAGYNAQNVKGKIALIERDPNKTYD
  gas57M6,1_21259  (449) VDFKNIKDSLGYDKSHQFAYVKESTDAGYNAQNVKGKIALIERDPNKTYD
```

FIG. 10K

```
                          501                                              550
  gas57M1_SF370    (499)  EMIALAKKHGALGVLIFNNKPGQSNRSMRLTANGMGIPSAFISHEFGKAM
  gas57M1_31075    (499)  EMIALAKKHGALGVLIFNNKPGQSNRSMRLTANGMGIPSAFISHEFGKAM
  gas57M1_31237    (499)  EMIALAKKHGALGVLIFNNKPGQSNRSMRLTANGMGIPSAFISHEFGKAM
   gas57M1_3348    (499)  EMIALAKKHGALGVLIFNNKPGQSNRSMRLTANGMGIPSAFISHEFGKAM
  gas57M2_34585    (499)  EMIALAKKHGALGVLIFNNKPGQSNRSMRLTANGMGIPSAFISHEFGKAM
 gas57M3,1_21398   (499)  EMIALAKKHGALGVLIFNNKPGQSNRSMRLTANGMGIPSAFISHEFGKAM
 gas57M44-61_20839 (499)  EMIALAKKHGALGVLIFNNKPGQSNRSMRLTANGMGIPSAFISHEFGKAM
 gas57M6,31_20022  (498)  EMIALAKKHGALGVLIFNNKPGQSNRSMRLTANGMGIPSAFISHEFGKAM
  gas57M11_20648   (497)  EMIALAKKHGALGVLIFNNKPGQSNRSMRLTANGMGIPSAFISHEFGKAM
   gas57M23_2071   (498)  EMIALAKKHGALGVLIFNNKPGQSNRSMRLTANGMGIPSAFISHEFGKAM
 gas57M18,3_40128  (499)  EMIALAKKHGALGVLIFNNKPGQSNRSMRLTANGMGIPSAFISHEFGKAM
   gas57M4_10092   (499)  EMIALAKKHGALGVLIFNNKPGQSNRSMRLTANGMGIPSAFISHEFGKAM
   gas57M4_30968   (499)  EMIALAKKHGALGVLIFNNKPGQSNRSMRLTANGMGIPSAFISHEFGKAM
 gas57M6,31_22692  (499)  EMIALAKKHGALGVLIFNNKPGQSNRSMRLTANGMGIPSAFISHEFGKAM
 gas57M68,5_22814  (498)  EMIALAKKHGALGVLIFNNKPGQSNRSMRLTSNGMGIPSAFISHEFGKAM
  gas57M68_23623   (499)  EMIALAKKHGALGVLIFNNKPGQSNRSMRLTSNGMGIPSAFISHEFGKAM
   gas57M2_10064   (497)  EMIALAKKHGALGVLIFNNKPGQSNRSMRLTANGMGIPSAFISYEFGKAM
   gas57M2_10065   (497)  EMIALAKKHGALGVLIFNNKPGQSNRSMRLTANGMGIPSAFISYEFGKAM
  gas57M77_10251   (497)  EMIALAKKHGALGVLIFNNKPGQSNRSMRLTANGMGIPSAFISHEFGKAM
  gas57M77_10527   (497)  EMIALAKKHGALGVLIFNNKPGQSNRSMRLTANGMGIPSAFISHEFGKAM
  gas57M77_20696   (497)  EMIALAKKHGALGVLIFNNKPGQSNRSMRLTANGMGIPSAFISHEFGKAM
  gas57M89_21915   (499)  EMIALAKKHGALGVLIFNNKPGQSNRSMRLTANGMGIPSAFISHEFGKAM
  gas57M89_23717   (499)  EMIALAKKHGALGVLIFNNKPGQSNRSMRLTANGMGIPSAFISHEFGKAM
  gas57M94_10134   (497)  EMIALAKKHGALGVLIFNNKPGQSNRSMRLTANGMGIPSAFISHEFGKAM
  gas57M28_10164   (497)  EMIALAKKHGALGVLIFNNKPGQSNRSMRLTANGMGIPSAFISHEFGKAM
  gas57M28_10218   (497)  EMIALAKKHGALGVLIFNNKPGQSNRSMRLTANGMGIPSAFISHEFGKAM
  gas57M28_10266   (497)  EMIALAKKHGALGVLIFNNKPGQSNRSMRLTANGMGIPSAFISHEFGKAM
  gas57M28_10299   (497)  EMIALAKKHGALGVLIFNNKPGQSNRSMRLTANGMGIPSAFISHEFGKAM
  gas57M28_30176   (497)  EMIALAKKHGALGVLIFNNKPGQSNRSMRLTANGMGIPSAFISHEFGKAM
  gas57M28_30574   (497)  EMIALAKKHGALGVLIFNNKPGQSNRSMRLTANGMGIPSAFISHEFGKAM
  gas57M6,9_21802  (500)  EMIALAKKHGALGVLIFNNKPGQSNRSMRLTSNGMGIPSAFISHEFGKAM
  gas57M75_10012   (501)  EMIALAKKHGALGVLIFNNKPGQSNRSMRLTANGMGIPSAFISHEFGKAM
  gas57M75_20671   (501)  EMIALAKKHGALGVLIFNNKPGQSNRSMRLTANGMGIPSAFISHEFGKAM
  gas57M75_30603   (501)  EMIALAKKHGALGVLIFNNKPGQSNRSMRLTANGMGIPSAFISHEFGKAM
  gas57M75_30207   (501)  EMIALAKKHGALGVLIFNNKPGQSNRSMRLTANGMGIPSAFISHEFGKAM
  gas57M22_20641   (500)  EMIALAKKHGALGVLIFNNKPGQSNRSMRLTANGMGIPSAFISHEFGKAM
  gas57M22_23465   (500)  EMIALAKKHGALGVLIFNNKPGQSNRSMRLTANGMGIPSAFISHEFGKAM
 gas57M3,1_30610   (500)  EMIALAKKHGALGVLIFNNKPGQSNRSMRLTANGMGIPSAFISHEFGKVM
 gas57M3,1_40603   (500)  EMIALAKKHGALGVLIFNNKPGQSNRSMRLTANGMGIPSAFISHEFGKVM
 gas57M3,28_24214  (500)  EMIALAKKHGALGVLIFNNKPGQSNRSMRLTANGMGIPSAFISHEFGKVM
 gas57M3,34_10307  (500)  EMIALAKKHGALGVLIFNNKPGQSNRSMRLTANGMGIPSAFISHEFGKVM
   gas57M4_40427   (500)  EMIALAKKHGALGVLIFNNKPGQSNRSMRLTANGMGIPSAFISHEFGKVM
   gas57M3_2721    (500)  EMIALAKKHGALGVLIFNNKPGQSNRSMRLTANGMGIPSAFISHEFGKAM
  gas57M12_10296   (499)  EMIALAKKHGALGVLIFNNKPGQSNRSMRLTANGMGIPSAFISHEFGKAM
  gas57M12_10035   (499)  EMIALAKKHGALGVLIFNNKPGQSNRSMRLTANGMGIPSAFISHEFGKAM
  gas57M12_20069   (499)  EMIALAKKHGALGVLIFNNKPGQSNRSMRLTANGMGIPSAFISHEFGKAM
  gas57M12_22432   (499)  EMIALAKKHGALGVLIFNNKPGQSNRSMRLTANGMGIPSAFISHEFGKAM
   gas57M4_40499   (499)  EMIALAKKHGALGVLIFNNKPGQSNRSMRLTANGMGIPSAFISHEFGKAM
 gas57M6,1_21259   (499)  EMIALAKKHGALGVLIFNNKPGQSNRSMRLTANGMGIPSAFISHEFGKAM
```

FIG. 10L

```
                               551                                                600
gas57M1_SF370      (549) SQLNGNGTGSLEFDSVVSKAPSQKGNEMNHFSNWGLTSDGYLKPDITAPG
gas57M1_31075      (549) SQLNGNGTGSLEFDSVVSKAPSQKGNEMNHFSNWGLTSDGYLKPDITAPG
gas57M1_31237      (549) SQLNGNGTGSLEFDSVVSKAPSQKGNEMNHFSNWGLTSDGYLKPDITAPG
gas57M1_3348       (549) SQLNGNGTGSLEFDSVVSKAPSQKGNEMNHFSNWGLTSDGYLKPDITAPG
gas57M2_34585      (549) SQLNGNGTGSLEFDSVVSKAPSQKGNEMNHFSNWGLTSDGYLKPDITAPG
gas57M3,1_21398    (549) SQLNGNGTGSLEFDSVVSKAPSQKGNEMNHFSNWGLTSDGYLKPDITAPG
gas57M44-61_20839  (549) SQLNGNGTGSLEFDSVVSKAPSQKGNEMNHFSNWGLTSDGYLKPDITAPG
gas57M6,31_20022   (548) SQLNGNGTGSLEFDSVVSKAPSQKGNEMNHFSNWGLTSDGYLKPDITAPG
gas57M11_20648     (547) SQLNGNGTGSLEFDSVVSKAPSQKGNEMNHFSNWGLTSDGYLKPDITAPG
gas57M23_2071      (548) SQLNGNGTGSLEFDSVVSKAPSQKGNEMNHFSNWGLTSDGYLKPDITAPG
gas57M18,3_40128   (549) SQLNGNGTGSLEFDSVVSKAPSQKGNEMNHFSNWGLTSDGYLKPDITAPG
gas57M4_10092      (549) SQLNGNGTGSLEFDSVVSKAPSQKGNEMNHFSNWGLTSDGYLKPDITAPG
gas57M4_30968      (549) SQLNGNGTGSLEFDSVVSKAPSQKGNEMNHFSNWGLTSDGYLKPDITAPG
gas57M6,31_22692   (549) SQLNGNGTGSLEFDSVVSKAPSQKGNEMNHFSNWGLTSDGYLKPDITAPG
gas57M68,5_22814   (548) SQLNGNGTGSLEFDSVVSKAPSQKGNEMNHFSNWGLTSDGYLKPDITAPG
gas57M68_23623     (549) SQLNGNGTGSLEFDSVVSKAPSQKGNEMNHFSNWGLTSDGYLKPDITAPG
gas57M2_10064      (547) SQLNGNGTGSLEFDSVVSKAPSQKGNEMNHFSNWGLTSDGYLKPDITAPG
gas57M2_10065      (547) SQLNGNGTGSLEFDSVVSKAPSQKGNEMNHFSNWGLTSDGYLKPDITAPG
gas57M77_10251     (547) SQLNGNGTGSLVFDSVVSKAPSQKGNEMNHFSNWGLTSDGYLKPDITAPG
gas57M77_10527     (547) SQLNGNGTGSLVFDSVVSKAPSQKGNEMNHFSNWGLTSDGYLKPDITAPG
gas57M77_20696     (547) SQLNGNGTGSLVFDSVVSKAPSQKGNEMNHFSNWGLTSDGYLKPDITAPG
gas57M89_21915     (549) SQLNGNGTGSLEFDSVVSKAPSQKGNEMNHFSNWGLTSDGYLKPDITAPG
gas57M89_23717     (549) SQLNGNGTGSLEFDSVVSKAPSQKGNEMNHFSNWGLTSDGYLKPDITAPG
gas57M94_10134     (547) SQLNTNGTGSLVFDSVVSKAPSQKGNEMNHFSNWGLTSDGYLKPDITAPG
gas57M28_10164     (547) SQLNGNGTGSLEFDSVVSKAPSQKGNEMNHFSNWGLTSDGYLKPDITAPG
gas57M28_10218     (547) SQLNGNGTGSLEFDSVVSKAPSQKGNEMNHFSNWGLTSDGYLKPDITAPG
gas57M28_10266     (547) SQLNGNGTGSLEFDSVVSKAPSQKGNEMNHFSNWGLTSDGYLKPDITAPG
gas57M28_10299     (547) SQLNGNGTGSLEFDSVVSKAPSQKGNEMNHFSNWGLTSDGYLKPDITAPG
gas57M28_30176     (547) SQLNGNGTGSLEFDSVVSKAPSQKGNEMNHFSNWGLTSDGYLKPDITAPG
gas57M28_30574     (547) SQLNGNGTGSLEFDSVVSKAPSQKGNEMNHFSNWGLTSDGYLKPDITAPG
gas57M6,9_21802    (550) SQLNGNGTGSLEFDSVVSKAPSQKGNEMNHFSNWGLTSDGYLKPDITAPG
gas57M75_10012     (551) SQLNGNGTGSLEFDSVVSKAPSQKGNEMNHFSNWGLTSDGYLKPDITAPG
gas57M75_20671     (551) SQLNGNGTGSLEFDSVVSKAPSQKGNEMNHFSNWGLTSDGYLKPDITAPG
gas57M75_30603     (551) SQLNGNGTGSLEFDSVVSKAPSQKGNEMNHFSNWGLTSDGYLKPDITAPG
gas57M75_30207     (551) SQLNGNGTGSLEFDSVVSKAPSQKGNEMNHFSNWGLTSDGYLKPDITAPG
gas57M22_20641     (550) SQLNGNGTGSLEFDSVVSKAPSQKGNEMNHFSNWGLTSDGYLKPDITAPG
gas57M22_23465     (550) SQLNGNGTGSLEFDSVVSKAPSQKGNEMNHFSNWGLTSDGYLKPDITAPG
gas57M3,1_30610    (550) SQLNGNGTGSLEFDSVVSKAPSQKGNEMNHFSNWGLTSDGYLKPDITAPG
gas57M3,1_40603    (550) SQLNGNGTGSLEFDSVVSKAPSQKGNEMNHFSNWGLTSDGYLKPDITAPG
gas57M3,28_24214   (550) SQLNGNGTGSLEFDSVVSKAPSQKGNEMNHFSNWGLTSDGYLKPDITAPG
gas57M3,34_10307   (550) SQLNGNGTGSLEFDSVVSKAPSQKGNEMNHFSNWGLTSDGYLKPDITAPG
gas57M4_40427      (550) SQLNGNGTGSLEFDSVVSKAPSQKGNEMNHFSNWGLTSDGYLKPDITAPG
gas57M3_2721       (550) SQLNGNGTGSLEFDSVVSKAPSQKGNEMNHFSNWGLTSDGYLKPDITAPG
gas57M12_10296     (549) SQLNGNGTGSLEFDSVVSKAPSQKGNEMNHFSNWGLTSDGYLKPDITAPG
gas57M12_10035     (549) SQLNGNGTGSLEFDSVVSKAPSQKGNEMNHFSNWGLTSDGYLKPDITAPG
gas57M12_20069     (549) SQLNGNGTGSLEFDSVVSKAPSQKGNEMNHFSNWGLTSDGYLKPDITAPG
gas57M12_22432     (549) SQLNGNGTGSLEFDSVVSKAPSQKGNEMNHFSNWGLTSDGYLKPDITAPG
gas57M4_40499      (549) SQLNGNGTGSLEFDSVVSKAPSQKGNEMNHFSNWGLTSDGYLKPDITAPG
gas57M6,1_21259    (549) SQLNGNGTGSLEFDSVVSKAPSQKGNEMNHFSNWGLTSDGYLKPDITAPG
```

FIG. 10M

```
                                601                                               650
    gas57M1_SF370      (599) GDIYSTYNDNHYGSQTGTSMASPQIAGASLLVKQYLEKTQPNLPKEKIAD
    gas57M1_31075     (599) GDIYSTYNDNHYGSQTGTSMASPQIAGASLLVKQYLEKTQPNLPKEKIAD
    gas57M1_31237     (599) GDIYSTYNDNHYGSQTGTSMASPQIAGASLLVKQYLEKTQPNLPKEKIAD
     gas57M1_3348     (599) GDIYSTYNDNHYGSQTGTSMASPQIAGASLLVKQYLEKTQPNLPKEKIAD
    gas57M2_34585     (599) GDIYSTYNDNHYGSQTGTSMASPQIAGASLLVKQYLEKTQPNLPKEKIAD
  gas57M3,1_21398     (599) GDIYSTYNDNHYGSQTGTSMASPQIAGASLLVKQYLEKTQPNLPKEKIAD
 gas57M44-61_20839    (599) GDIYSTYNDNHYGSQTGTSMASPQIAGASLLVKQYLEKTQPNLPKEKIAD
  gas57M6,31_20022    (598) GDIYSTYNDNHYGSQTGTSMASPQIAGASLLVKQYLEKTQPNLPKEKIAD
    gas57M11_20648    (597) GDIYSTYNDNHYGSQTGTSMASPQIAGASLLVKQYLEKTQPNLPKEKIAD
    gas57M23_2071     (598) GDIYSTYNDNHYGSQTGTSMASPQIAGASLLVKQYLEKTQPNLPKEKIAD
  gas57M18,3_40128    (599) GDIYSTYNDNHYGSQTGTSMASPQIAGASLLVKQYLEKTQPNLPKEKIAD
    gas57M4_10092     (599) GDIYSTYNDNHYGSQTGTSMASPQIAGASLLVKQYLEKTQPNLPKEKIAD
    gas57M4_30968     (599) GDIYSTYNDNHYGSQTGTSMASPQIAGASLLVKQYLEKTQPNLPKEKIAD
  gas57M6,31_22692    (599) GDIYSTYNDNHYGSQTGTSMASPQIAGASLLVKQYLEKTQPNLPKEKIAD
  gas57M68,5_22814    (598) GDIYSTYNDNHYGSQTGTSMASPQIAGASLLVKQYLEKTQPNLPKEKIAD
    gas57M68_23623    (599) GDIYSTYNDNHYGSQTGTSMASPQIAGASLLVKQYLEKTQPNLPKEKIAD
    gas57M2_10064     (597) GDIYSTYNDNHYGSQTGTSMASPQIAGASLLVKQYLEKTQPNLPKEKIAD
    gas57M2_10065     (597) GDIYSTYNDNHYGSQTGTSMASPQIAGASLLVKQYLEKTQPNLPKEKIAD
    gas57M77_10251    (597) GDIYSTYNDNHYGSQTGTSMASPQIAGASLLVKQYLEKTQPNLPKEKIAD
    gas57M77_10527    (597) GDIYSTYNDNHYGSQTGTSMASPQIAGASLLVKQYLEKTQPNLPKEKIAD
    gas57M77_20696    (597) GDIYSTYNDNHYGSQTGTSMASPQIAGASLLVKQYLEKTQPNLPKEKIAD
    gas57M89_21915    (599) GDIYSTYNDNHYGSQTGTSMASPQIAGASLLVKQYLEKTQPNLPKEKIAD
    gas57M89_23717    (599) GDIYSTYNDNHYGSQTGTSMASPQIAGASLLVKQYLEKTQPNLPKEKIAD
    gas57M94_10134    (597) GDIYSTYNDNHYGSQTGTSMASPQIAGASLLVKQYLEKTQPNLPKEKIAD
    gas57M28_10164    (597) GDIYSTYNDNHYGSQTGTSMASPQIAGASLLVKQYLEKTQPNLPKEKIAD
    gas57M28_10218    (597) GDIYSTYNDNHYGSQTGTSMASPQIAGASLLVKQYLEKTQPNLPKEKIAD
    gas57M28_10266    (597) GDIYSTYNDNHYGSQTGTSMASPQIAGASLLVKQYLEKTQPNLPKEKIAD
    gas57M28_10299    (597) GDIYSTYNDNHYGSQTGTSMASPQIAGASLLVKQYLEKTQPNLPKEKIAD
    gas57M28_30176    (597) GDIYSTYNDNHYGSQTGTSMASPQIAGASLLVKQYLEKTQPNLPKEKIAD
    gas57M28_30574    (597) GDIYSTYNDNHYGSQTGTSMASPQIAGASLLVKQYLEKTQPNLPKEKIAD
   gas57M6,9_21802    (600) GDIYSTYNDNHYGSQTGTSMASPQIAGASLLVKQYLEKTQPNLPKEKIAD
    gas57M75_10012    (601) GDIYSTYNDNHYGSQTGTSMASPQIAGASLLVKQYLEKTQPNLPKEKIAD
    gas57M75_20671    (601) GDIYSTYNDNHYGSQTGTSMASPQIAGASLLVKQYLEKTQPNLPKEKIAD
    gas57M75_30603    (601) GDIYSTYNDNHYGSQTGTSMASPQIAGASLLVKQYLEKTQPNLPKEKIAD
    gas57M75_30207    (601) GDIYSTYNDNHYGSQTGTSMASPQIAGASLLVKQYLEKTQPNLPKEKIAD
    gas57M22_20641    (600) GDIYSTYNDNHYGSQTGTSMASPQIAGASLLVKQYLEKTQPNLPKEKIAD
    gas57M22_23465    (600) GDIYSTYNDNHYGSQTGTSMASPQIAGASLLVKQYLEKTQPNLPKEKIAD
  gas57M3,1_30610    (600) GDIYSTYNDNHYGSQTGTSMASPQIAGASLLVKQYLEKTQPNLPKEKIAD
  gas57M3,1_40603    (600) GDIYSTYNDNHYGSQTGTSMASPQIAGASLLVKQYLEKTQPNLPKEKIAD
  gas57M3,28_24214   (600) GDIYSTYNDNHYGSQTGTSMASPQIAGASLLVKQYLEKTQPNLPKEKIAD
  gas57M3,34_10307   (600) GDIYSTYNDNHYGSQTGTSMASPQIAGASLLVKQYLEKTQPNLPKEKIAD
    gas57M4_40427     (600) GDIYSTYNDNHYGSQTGTSMASPQIAGASLLVKQYLEKTQPNLPKEKIAD
     gas57M3_2721     (600) GDIYSTYNDNHYGSQTGTSMASPQIAGASLLVKQYLEKTQPNLPKEKIAD
    gas57M12_10296    (599) GDIYSTYNDNHYGSQTGTSMASPQIAGASLLVKQYLEKTQPNLPKEKIAD
    gas57M12_10035    (599) GDIYSTYNDNHYGSQTGTSMASPQIAGASLLVKQYLEKTQPNLPKEKIAD
    gas57M12_20069    (599) GDIYSTYNDNHYGSQTGTSMASPQIAGASLLVKQYLEKTQPNLPKEKIAD
    gas57M12_22432    (599) GDIYSTYNDNHYGSQTGTSMASPQIAGASLLVKQYLEKTQPNLPKEKIAD
    gas57M4_40499     (599) GDIYSTYNDNHYGSQTGTSMASPQIAGASLLVKQYLEKTQPNLPKEKIAD
  gas57M6,1_21259    (599) GDIYSTYNDNHYGSQTGTSMASPQIAGASLLVKQYLEKTQPNLPKEKIAD
```

FIG. 10N

```
                              651                                               700
   gas57M1_SF370      (649) IVKNLLMSNAQIHVNPETKTTTSPRQQGAGLLNIDGAVTSGLYVTGKDNY
    gas57M1_31075    (649) IVKNLLMSNAQIHVNPETKTTTSPRQQGAGLLNIDGAVTSGLYVTGKDNY
    gas57M1_31237    (649) IVKNLLMSNAQIHVNPETKTTTSPRQQGAGLLNIDGAVTSGLYVTGKDNY
     gas57M1_3348    (649) IVKNLLMSNAQIHVNPETKTTTSPRQQGAGLLNIDGAVTSGLYVTGKDNY
    gas57M2_34585    (649) IVKNLLMSNAQIHVNPETKTTTSPRQQGAGLLNIDGAVTSGLYVTGKDNY
   gas57M3,1_21398   (649) IVKNLLMSNAQIHVNPETKTTTSPRQQGAGLLNIDGAVTSGLYVTGKDNY
  gas57M44-61_20839  (649) IVKNLLMSNAQIHVNPETKTTTSPRQQGAGLLNIDGAVTSGLYVTGKDNY
   gas57M6,31_20022  (648) IVKNLLMSNAQIHVNPETKTTTSPRQQGAGLLNIDGAVTSGLYVTGKDNY
    gas57M11_20648   (647) IVKNLLMSNAQIHVNPETKTTTSPRQQGAGLLNIDGAVTSGLYVTGKDNY
    gas57M23_2071    (648) IVKNLLMSNAQIHVNPETKTTTSPRQQGAGLLNIDGAVTSGLYVTGKDNY
  gas57M18,3_40128   (649) IVKNLLMSNAQIHVNPETKTTTSPRQQGAGLLNIDGAVTSGLYVTGKDNY
    gas57M4_10092    (649) IVKNLLMSNAQIHVNPETKTTTSPRQQGAGLLNIDGAVTSGLYVTGKDNY
    gas57M4_30968    (649) IVKNLLMSNAQIHVNPETKTTTSPRQQGAGLLNIDGAVTSGLYVTGKDNY
  gas57M6,31_22692   (649) IVKNLLMSNAQIHVNPETKTTTSPRQQGAGLLNIDGAVTSGLYVTGKDNY
  gas57M68,5_22814   (648) IVKNLLMSNAQIHVNPETKTTTSPRQQGAGLLNIDGAVTSGLYVTGKDNY
    gas57M68_23623   (649) IVKNLLMSNAQIHVNPETKTTTSPRQQGAGLLNIDGAVTSGLYVTGKDNY
    gas57M2_10064    (647) IVKNLLMSNAQIHVNPETKTTTSPRQQGAGLLNIDGAVTSGLYVTGKDNY
    gas57M2_10065    (647) IVKNLLMSNAQIHVNPETKTTTSPRQQGAGLLNIDGAVTSGLYVTGKDNY
    gas57M77_10251   (647) IVKNLLMSNAQIHVNPETKTTTSPRQQGAGLLNIDGAVTSGLYVTGKDNY
    gas57M77_10527   (647) IVKNLLMSNAQIHVNPETKTTTSPRQQGAGLLNIDGAVTSGLYVTGKDNY
    gas57M77_20696   (647) IVKNLLMSNAQIHVNPETKTTTSPRQQGAGLLNIDGAVTSGLYVTGKDNY
    gas57M89_21915   (649) IVKNLLMSNAQIHVNPETKTTTSPRQQGAGLLNIDGAVTSGLYVTGKDNY
    gas57M89_23717   (649) IVKNLLMSNAQIHVNPETKTTTSPRQQGAGLLNIDGAVTSGLYVTGKDNY
    gas57M94_10134   (647) IVKNLLMSNAQIHVNPETKMTTSPRQQGAGLLNIDGAVTSGLYVTGKDNY
    gas57M28_10164   (647) IVKNLLMSNAQIHVNPETKTTTSPRQQGAGLLNIDGAVTSGLYVTGKDNY
    gas57M28_10218   (647) IVKNLLMSNAQIHVNPETKTTTSPRQQGAGLLNIDGAVTSGLYVTGKDNY
    gas57M28_10266   (647) IVKNLLMSNAQIHVNPETKTTTSPRQQGAGLLNIDGAVTSGLYVTGKDNY
    gas57M28_10299   (647) IVKNLLMSNAQIHVNPETKTTTSPRQQGAGLLNIDGAVTSGLYVTGKDNY
    gas57M28_30176   (647) IVKNLLMSNAQIHVNPETKTTTSPRQQGAGLLNIDGAVTSGLYVTGKDNY
    gas57M28_30574   (647) IVKNLLMSNAQIHVNPETKTTTSPRQQGAGLLNIDGAVTSGLYVTGKDNY
   gas57M6,9_21802   (650) IVKNLLMSNAQIHVNPETKTTTSPRQQGAGLLNIDGAVTSGLYVTGKDNY
    gas57M75_10012   (651) IVKNLLMSNAQIHVNPETKTTTSPRQQGAGLLNIDGAVTSGLYVTGKDNY
    gas57M75_20671   (651) IVKNLLMSNAQIHVNPETKTTTSPRQQGAGLLNIDGAVTSGLYVTGKDNY
    gas57M75_30603   (651) IVKNLLMSNAQIHVNPETKTTTSPRQQGAGLLNIDGAVTSGLYVTGKDNY
    gas57M75_30207   (651) IVKNLLMSNAQIHVNPETKTTTSPRQQGAGLLNIDGAVTSGLYVTGKDNY
    gas57M22_20641   (650) IVKNLLMSNAQIHVNPETKTTTSPRQQGAGLLNIDGAVTSGLYVTGKDNY
    gas57M22_23465   (650) IVKNLLMSNAQIHVNPETKTTTSPRQQGAGLLNIDGAVTSGLYVTGKDNY
   gas57M3,1_30610   (650) IVKNLLMSNAQIHVNPETKTTTSPRQQGAGLLNIDGAVTSGLYVTGKDNY
   gas57M3,1_40603   (650) IVKNLLMSNAQIHVNPETKTTTSPRQQGAGLLNIDGAVTSGLYVTGKDNY
  gas57M3,28_24214   (650) IVKNLLMSNAQIHVNPETKTTTSPRQQGAGLLNIDGAVTSGLYVTGKDNY
  gas57M3,34_10307   (650) IVKNLLMSNAQIHVNPETKTTTSPRQQGAGLLNIDGAVTSGLYVTGKDNY
    gas57M4_40427    (650) IVKNLLMSNAQIHVNPETKTTTSPRQQGAGLLNIDGAVTSGLYVTGKDNY
     gas57M3_2721    (650) IVKNLLMSNAQIHVNPETKTTTSPRQQGAGLLNIDGAVTSGLYVTGKDNY
    gas57M12_10296   (649) IVKNLLMSNAQIHVNPETKTTTSPRQQGAGLLNIDGAVTSGLYVTGKDNY
    gas57M12_10035   (649) IVKNLLMSNAQIHVNPETKTTTSPRQQGAGLLNIDGAVTSGLYVTGKDNY
    gas57M12_20069   (649) IVKNLLMSNAQIHVNPETKTTTSPRQQGAGLLNIDGAVTSGLYVTGKDNY
    gas57M12_22432   (649) IVKNLLMSNAQIHVNPETKTTTSPRQQGAGLLNIDGAVTSGLYVTGKDNY
    gas57M4_40499    (649) IVKNLLMSNAQIHVNPETKTTTSPRQQGAGLLNIDGAVTSGLYVTGKDNY
   gas57M6,1_21259   (649) IVKNLLMSNAQIHVNPETKTTTSPRQQGAGLLNIDGAVTSGLYVTGKDNY
```

FIG. 10O

```
                              701                                                750
   gas57M1_SF370     (699)  GSISLGNITDTMTFDVTVHNLSNKDKTLRYDTELLTDHVDPQKGRFTLTS
   gas57M1_31075     (699)  GSISLGNITDTMTFDVTVHNLSNKDKTLRYDTELLTDHVDPQKGRFTLTS
   gas57M1_31237     (699)  GSISLGNITDTMTFDVTVHNLSNKDKTLRYDTELLTDHVDPQKGRFTLTS
    gas57M1_3348     (699)  GSISLGNITDTMTFDVTVHNLSNKDKTLRYDTELLTDHVDPQKGRFTLTS
   gas57M2_34585     (699)  GSISLGNITDTMTFDVTVHNLSNKDKTLRYDTELLTDHVDPQKGRFTLTS
  gas57M3,1_21398    (699)  GSISLGNITDTMTFDVTVHNLSNKAKTLRYDTELLTDHVDPQKGRFTLTS
 gas57M44-61_20839   (699)  GSISLGNVTDTMTFDVTVHNLSNKAKTLRYDTELLTDHVDPQKGRFTLTS
  gas57M6,31_20022   (698)  GSISLGNVTDTMTFDVTVHNLSNKAKTLRYDTELLTDHVDPQKGRFTLTS
   gas57M11_20648    (697)  GSISLGNITDTMTFDVTVHNLSNKAKTLRYDTELLTDHVDPQKGRFTLTS
    gas57M23_2071    (698)  GSISLGNITDTMTFDVTVHNLSNKAKTLRYDTELLTDHVDPQKGRFTLTS
  gas57M18,3_40128   (699)  GSISLGNITDTMTFDVTVHNLSNKDKTLRYDTELLTDHVDPQKGRFTLTS
   gas57M4_10092     (699)  GSISLGNITDTMTFDVTVHNLSNKDKTLRYDTELLTDHVDPQKGRFTLTS
   gas57M4_30968     (699)  GSISLGNITDTMTFDVTVHNLSNKDKTLRYDTELLTDHVDPQKGRFTLTS
  gas57M6,31_22692   (699)  GSISLGNITDTMTFDVTVHNLSNKDKTLRYDTELLTDHVDPQKGRFTLTS
  gas57M68,5_22814   (698)  GSISLGNITDTMTFDVTVHNLSNKDKTLRYDTELLTDHVDPQKGRFTLTS
   gas57M68_23623    (699)  GSISLGNITDTMTFDVTVHNLSNKDKTLRYDTELLTDHVDPQKGRFTLTS
   gas57M2_10064     (697)  GSISLGNITDTMTFDVTVHNLSNKAKTLRYDTELLTDHVDPQKGRFTLTS
   gas57M2_10065     (697)  GSISLGNITDTMTFDVTVHNLSNKAKTLRYDTELLTDIIVDPQKGRFTLTS
   gas57M77_10251    (697)  GSISLGNITDTMTFDVTVHNLSNKAKTLRYDTELLTDHVDPQKGRFTLTS
   gas57M77_10527    (697)  GSISLGNITDTMTFDVTVHNLSNKAKTLRYDTELLTDHVDPQKGRFTLTS
   gas57M77_20696    (697)  GSISLGNITDTMTFDVTVHNLSNKAKTLRYDTELLTDHVDPQKGRFTLTS
   gas57M89_21915    (699)  GSISLGNITDTMTFDVTVHNLSNKAKTLRYDTELLTDHVDPQKGRFTLTS
   gas57M89_23717    (699)  GSISLGNITDTMTFDVTVHNLSNKDKTLRYDTELLTDHVDPQKGRFTLTS
   gas57M94_10134    (697)  GSISLGNITDTMTFDVTVHNLSNKAKTLRYDTELLTDHVDPQKGHFTLTS
   gas57M28_10164    (697)  GSISLGNITDTMTFDVTVHNLSNKAKTLRYDTELLTDHVDPQKGRFTLTS
   gas57M28_10218    (697)  GSISLGNITDTMTFDVTVHNLSNKAKTLRYDTELLTDHVDPQKGRFTLTS
   gas57M28_10266    (697)  GSISLGNITDTMTFDVTVHNLSNKAKTLRYDTELLTDHVDPQKGRFTLTS
   gas57M28_10299    (697)  GSISLGNITDTMTFDVTVHNLSNKAKTLRYDTELLTDHVDPQKGRFTLTS
   gas57M28_30176    (697)  GSISLGNITDTMTFDVTVHNLSNKAKTLRYDTELLTDHVDPQKGRFTLTS
   gas57M28_30574    (697)  GSISLGNITDTMTFDVTVHNLSNKAKTLRYDTELLTDHVDPQKGRFTLTS
   gas57M6,9_21802   (700)  GSISLGNITDTMTFDVTVHNLSNKAKTLRYDTELLTDHVDPQKGRFTLTS
   gas57M75_10012    (701)  GSISLGNITDTMTFDVTVHNLSNKDKTLRYDTELLTDHVDPQKGRFTLTS
   gas57M75_20671    (701)  GSISLGNITDTMTFDVTVHNLSNKDKTLRYDTELLTDIIVDPQKGRFTLTS
   gas57M75_30603    (701)  GSISLGNITDTMTFDVTVHNLSNKDKTLRYDTELLTDHVDPQKGRFTLTS
   gas57M75_30207    (701)  GSISLGNITDTMTFDVTVHNLSNKDKTLRYDTELLTDHVDPQKGRFTLTS
   gas57M22_20641    (700)  GSISLGNITDTMTFDVTVHNLSNKDKTLRYDTELLTDHVDPQKGRFTLTS
   gas57M22_23465    (700)  GSISLGNITDTMTFDVTVHNLSNKDKTLRYDTELLTDHVDPQKGRFTLTS
  gas57M3,1_30610    (700)  GSISLGNITDTMTFDVTVHNLSNKAKTLRYDTELLTDHVDPQKGRFTLTS
  gas57M3,1_40603    (700)  GSISLGNITDTMTFDVTVHNLSNKAKTLRYDTELLTDHVDPQKGRFTLTS
  gas57M3,28_24214   (700)  GSISLGNITDTMTFDVTVHNLSNKAKTLRYDTELLTDHVDPQKGRFTLTS
  gas57M3,34_10307   (700)  GSISLGNITDTMTFDVTVHNLSNKAKTLRYDTELLTDHVDPQKGRFTLTS
   gas57M4_40427     (700)  GSISLGNITDTMTFDVTVHNLSNKAKTLRYDTELLTDHVDPQKGRFTLTS
   gas57M3_2721      (700)  GSISLGNITDTMTFDVTVINLSNKAKTLRYDTELLTDHVDPQKGRFTLTS
   gas57M12_10296    (699)  GSISLGNITDTMTFDVTVHNLSNKAKTLRYDTELLTDHVDPQKGRFTLTS
   gas57M12_10035    (699)  GSISLGNITDTMTFDVTVHNLSNKAKTLRYDTELLTDHVDPQKGRFTLTS
   gas57M12_20069    (699)  GSISLGNITDTMTFDVTVHNLSNKAKTLRYDTELLTDHVDPQKGRFTLTS
   gas57M12_22432    (699)  GSISLGNITDTMTFDVTVHNLSNKAKTLRYDTELLTDHVDPQKGRFTLTS
   gas57M4_40499     (699)  GSISLGNITDTMTFDVTVHNLSNKAKTLRYDTELLTDHVDPQKGRFTLTS
  gas57M6,1_21259    (699)  GSISLGNITDTMTFDVTVHNLSNKAKTLRYDTELLTDHVDPQKGRFTLTS
```

FIG. 10P

```
                        751                                                      800
gas57M1_SF370     (749) HSLKTYQGGEVTVPANGKVTVRVTMDVSQFTKELTKQMPNGYYLEGFVRF
gas57M1_31075     (749) HSLKTYQGGEVTVPANGKVTVRVTMDVSQFTKELTKQMPNGYYLEGFVRF
gas57M1_31237     (749) HSLKTYQGGEVTVPANGKVTVRVTMDVSQFTKELTKQMPNGYYLEGFVRF
gas57M1_3348      (749) HSLKTYQGGEVTVPANGKVTVRVTMDVSQFTKELTKQMPNGYYLEGFVRF
gas57M2_34585     (749) HSLKTYQGGEVTVPANGKVTVRVTMDVSQFTKELTKQMPNGYYLEGFVRF
gas57M3,1_21398   (749) RSLKTYQGGEVTVPANGKVTVKVTMDVSQFTKELTKQMPNGYYLEGFVRF
gas57M44-61_20839 (749) RSLKTYQGGEVTVPANGKVTVRVTMDVSQFTKELTKQMPNGYYLEGFVRF
gas57M6,31_20022  (748) RSLKTYQGGEVTVPANGKVTVRVTMDVSQFTKELTKQMPNGYYLEGFVRF
gas57M11_20648    (747) RSLKTYQGGEVTVPANGKVTVRVTMDVSQFTKELTKQMPNGYYLEGFVRF
gas57M23_2071     (748) RSLKTYQGGEVTVPANGKVTVKVTMDVSQFTKELTKQMPNGYYLEGFVRF
gas57M18,3_40128  (749) RSLKTYQGGEVTVPANGKVTVRVTMDVSQFTKELTKQMPNGYYLEGFVRF
gas57M4_10092     (749) RSLKTYQGGEVTVPANGKVTVRVTMDVSQFTKELTKQMPNGYYLEGFVRF
gas57M4_30968     (749) RSLKTYQGGEVTVPANGKVTVRVTMDVSQFTKELTKQMPNGYYLEGFVRF
gas57M6,31_22692  (749) RSLKTYQGGEVTVPANGKVTVRVTMDVSQFTKELTKQMPNGYYLEGFVRF
gas57M68,5_22814  (748) RSLKTYQGGEVTVPANGKVTVRVTMDVSQFTKELTKQMPNGYYLEGFVRF
gas57M68_23623    (749) RSLKTYQGGEVTVPANGKVTVRVTMDVSQFTKELTKQMPNGYYLEGFVRF
gas57M2_10064     (747) RSLKTYQGGEVTVPANGKVTVRVTMDVSQFTKELTKQMPNGYYLEGFVRF
gas57M2_10065     (747) RSLKTYQGGEVTVPANGKVTVRVTMDVSQFTKELTKQMPNGYYLEGFVRF
gas57M77_10251    (747) RSLKTYQGGEVTVPANGKVTVKVTMDVSQFTKELTKQMPNGYYLEGFVRF
gas57M77_10527    (747) RSLKTYQGGEVTVPANGKVTVKVTMDVSQFTKELTKQMPNGYYLEGFVRF
gas57M77_20696    (747) RSLKTYQGGEVTVPANGKVTVKVTMDVSQFTKELTKQMPNGYYLEGFVRF
gas57M89_21915    (749) RSLKTYQGGEVTVPANGKVTVRVTMDVSQFTKELTKQMPNGYYLEGFVRF
gas57M89_23717    (749) RSLKTYQGGEVTVPANGKVTVRVTMDVSQFTKELTKQMPNGYYLEGFVRF
gas57M94_10134    (747) RSLKTYQGGEVTVPANGKVTVRVTMDVSQFTKELTKQMPNGYYLEGFVRF
gas57M28_10164    (747) RSLKTYQGGEVTVPANGKVTVRVTMDVSQFTKELTKQMPNGYYLEGFVRF
gas57M28_10218    (747) RSLKTYQGGEVTVPANGKVTVRVTMDVSQFTKELTKQMPNGYYLEGFVRF
gas57M28_10266    (747) RSLKTYQGGEVTVPANGKVTVRVTMDVSQFTKELTKQMPNGYYLEGFVRF
gas57M28_10299    (747) RSLKTYQGGEVTVPANGKVTVRVTMDVSQFTKELTKQMPNGYYLEGFVRF
gas57M28_30176    (747) RSLKTYQGGEVTVPANGKVTVRVTMDVSQFTKELTKQMPNGYYLEGFVRF
gas57M28_30574    (747) RSLKTYQGGEVTVPANGKVTVRVTMDVSQFTKELTKQMPNGYYLEGFVRF
gas57M6,9_21802   (750) RSLKTYQGGEVTVPANGKVTVRVTMDVSQFTKELTKQMPNGYYLEGFVRF
gas57M75_10012    (751) RSLKTYQGGEVTVPANGKVTVRVTMDVSQFTKELTKQMPNGYYLEGFVRF
gas57M75_20671    (751) RSLKTYQGGEVTVPANGKVTVRVTMDVSQFTKELTKQMPNGYYLEGFVRF
gas57M75_30603    (751) RSLKTYQGGEVTVPANGKVTVRVTMDVSQFTKELTKQMPNGYYLEGFVRF
gas57M75_30207    (751) RSLKTYQGGEVTVPANGKVTVRVTMDVSQFTKELTKQMPNGYYLEGFVRF
gas57M22_20641    (750) RSLKTYQGGEVTVPANGKVTVRVTMDVSQFTKELTKQMPNGYYLEGFVRF
gas57M22_23465    (750) RSLKTYQGGEVTVPANGKVTVRVTMDVSQFTKELTKQMPNGYYLEGFVRF
gas57M3,1_30610   (750) RSLKTYQGGEVTVPANGKVTVRVTMDVSQFTKELTKQMPNGYYLEGFVRF
gas57M3,1_40603   (750) RSLKTYQGGEVTVPANGKVTVRVTMDVSQFTKELTKQMPNGYYLEGFVRF
gas57M3,28_24214  (750) RSLKTYQGGEVTVPANGKVTVRVTMDVSQFTKELTKQMPNGYYLEGFVRF
gas57M3,34_10307  (750) RSLKTYQGGEVTVPANGKVTVRVTMDVSQFTKELTKQMPNGYYLEGFVRF
gas57M4_40427     (750) RSLKTYQGGEVTVPANGKVTVRVTMDVSQFTKELTKQMPNGYYLEGFVRF
gas57M3_2721      (750) RSLKTYQGGEVTVPANGKVTVRVTMDVSQFTKELTKQMPNGYYLEGFVRF
gas57M12_10296    (749) RSLKTYQGGEVTVPANGKVTVRVTMDVSQFTKELTKQMPNGYYLEGFVRF
gas57M12_10035    (749) RSLKTYQGGEVTVPANGKVTVRVTMDVSQFTKELTKQMPNGYYLEGFVRF
gas57M12_20069    (749) RSLKTYQGGEVTVPANGKVTVRVTMDVSQFTKELTKQMPNGYYLEGFVRF
gas57M12_22432    (749) RSLKTYQGGEVTVPANGKVTVRVTMDVSQFTKELTKQMPNGYYLEGFVRF
gas57M4_40499     (749) RSLKTYQGGEVTVPANGKVTVRVTMDVSQFTKELTKQMPNGYYLEGFVRF
gas57M6,1_21259   (749) RSLKTYQGGEVTVPANGKVTVRVTMDVSQFTKELTKQMPNGYYLEGFVRF
```

FIG. 10Q

```
                              801                                              850
      gas57M1_SF370    (799)  RDSQDDQLNRVNIPFVGFKGQFENLAVAEESIYRLKSQGKTGFYFDESGP
      gas57M1_31075   (799)  RDSQDDQLNRVNIPFVGFKGQFENLAVAEESIYRLKSQGKTGFYFDESGP
      gas57M1_31237   (799)  RDSQDDQLNRVNIPFVGFKGQFENLAVAEESIYRLKSQGKTGFYFDESGP
       gas57M1_3348   (799)  RDSQDDQLNRVNIPFVGFKGQFENLAVAEESIYRLKSQGKTGFYFDESGP
      gas57M2_34585   (799)  RDSQDDQLNRVNIPFVGFKGQFENLAVAEESIYRLKSQGKTGFYFDESGP
     gas57M3,1_21398  (799)  RDSQDDQLNRVNIPFVGFKGQFENLAVAEESIYRLKSQGKTGFYFDESGP
    gas57M44-61_20839 (799)  RDSQDDQLNRVNIPFVGFKGQFENLAVAEESIYRLKSQGKTGFYFDESGP
     gas57M6,31_20022 (798)  RDSQDAQLNRVNIPFVGFKGQFENLAVAEESIYRLKSQGKTGFYFDESGP
       gas57M11_20648 (797)  RDSQDDQLNRVNIPFVGFKGQFENLAVAEESIYRLKSQGKTGFYFDESGP
       gas57M23_2071  (798)  RDSQDAQLNRVNIPFVGFKGQFENLAVAEESIYRLKSQGKTGFYFDESGP
     gas57M18,3_40128 (799)  RDSQDDQLNRVNIPFVGFKGQFENLAVAEESIYRLKSQGKTGFYFDESGP
       gas57M4_10092  (799)  RDSQDDQLNRVNIPFVGFKGQFENLAVAEESIYRLKSQGKTGFYFDESGP
       gas57M4_30968  (799)  RDSQDDQLNRVNIPFVGFKGQFENLAVAEESIYRLKSQGKTGFYFDESGP
     gas57M6,31_22692 (799)  RDSQDDQLNRVNIPFVGFKGQFENLAVAEESIYRLKSQGKTGFYFDESGP
     gas57M68,5_22814 (798)  RDSQDDQLNRVNIPFVGFKGQFENLAVAEESIYRLKSQGKTGFYFDESGP
       gas57M68_23623 (799)  RDSQDDQLNRVNIPFVGFKGQFENLAVAEESIYRLKSQGKTGFYFDESGP
       gas57M2_10064  (797)  RDSQDDQLNRVNIPFVGFKGQFENLAVAEESIYRLKSQGKTGFYFDESGP
       gas57M2_10065  (797)  RDSQDDQLNRVNIPFVGFKGQFENLAVAEESIYRLKSQGKTGFYFDESGP
      gas57M77_10251  (797)  RDSQDDQLNRVNIPFVGFKGQFENLAVAEESIYRLKSQGKTGFYFDESGP
      gas57M77_10527  (797)  RDSQDDQLNRVNIPFVGFKGQFENLAVAEESIYRLKSQGKTGFYFDESGP
      gas57M77_20696  (797)  RDSQDDQLNRVNIPFVGFKGQFENLAVAEESIYRLKSQGKTGFYFDESGP
      gas57M89_21915  (799)  RDSQDDQLNRVNIPFVGFKGQFENLAVAEESIYRLKSQGKTGFYFDESGP
      gas57M89_23717  (799)  RDSQDDQLNRVNIPFVGFKGQFENLAVAEESIYRLKSQGKTGFYFDESGP
      gas57M94_10134  (797)  RDSQDDQLNRVNIPFVGFKGQFENLAVAEESIYRLKSQGKTGFYFDESGP
      gas57M28_10164  (797)  RDSQDDQLNRVNIPFVGFKGQFENLAVAEESIYRLKSQGKTGFYFDESGP
      gas57M28_10218  (797)  RDSQDDQLNRVNIPFVGFKGQFENLAVAEESIYRLKSQGKTGFYFDESGP
      gas57M28_10266  (797)  RDSQDDQLNRVNIPFVGFKGQFENLAVAEESIYRLKSQGKTGFYFDESGP
      gas57M28_10299  (797)  RDSQDDQLNRVNIPFVGFKGQFENLAVAEESIYRLKSQGKTGFYFDESGP
      gas57M28_30176  (797)  RDSQDDQLNRVNIPFVGFKGQFENLAVAEESIYRLKSQGKTGFYFDESGP
      gas57M28_30574  (797)  RDSQDDQLNRVNIPFVGFKGQFENLAVAEESIYRLKSQGKTGFYFDESGP
     gas57M6,9_21802  (800)  RDSQDDQLNRVNIPFVGFKGQFENLAVAEESIYRLKSQGKTGFYFDESGP
      gas57M75_10012  (801)  RDSQDDQLNRVNIPFVGFKGQFENLAVAEESIYRLKSQGKTGFYFDESGP
      gas57M75_20671  (801)  RDSQDDQLNRVNIPFVGFKGQFENLAVAEESIYRLKSQGKTGFYFDESGP
      gas57M75_30603  (801)  RDSQDDQLNRVNIPFVGFKGQFENLAVAEESIYRLKSQGKTGFYFDESGP
      gas57M75_30207  (801)  RDSQDDQLNRVNIPFVGFKGQFENLAVAEESIYRLKSQGKTGFYFDESGP
      gas57M22_20641  (800)  RDSQDAQLNRVNIPFVGFKGQFENLAVAEESIYRLKSQGKTGFYFDESGP
      gas57M22_23465  (800)  RDSQDDQLNRVNIPFVGFKGQFENLAVAEESIYRLKSQGKTGFYFDESGP
     gas57M3,1_30610  (800)  RDSQDDQLNRVNIPFVGFKGQFENLAVAEESIYRLKSQGKTGFYFDESGP
     gas57M3,1_40603  (800)  RDSQDDQLNRVNIPFVGFKGQFENLAVAEESIYRLKSQGKTGFYFDESGP
    gas57M3,28_24214  (800)  RDSQDDQLNRVNIPFVGFKGQFENLAVAEESIYRLKSQGKTGFYFDESGP
    gas57M3,34_10307  (800)  RDSQDDQLNRVNIPFVGFKGQFENLAVAEESIYRLKSQGKTGFYFDESGP
      gas57M4_40427   (800)  RDSQDDQLNRVNIPFVGFKGQFENLAVAEESIYRLKSQGKTGFYFDESGP
       gas57M3_2721   (800)  RDSQDDQLNRVNIPFVGFKGQFENLAVAEESIYRLKSQGKTGFYFDESGP
      gas57M12_10296  (799)  RDSQDDQLNRVNIPFVGFKGQFENLAVAEESIYRLKSQGKTGFYFDESGP
      gas57M12_10035  (799)  RDSQDDQLNRVNIPFVGFKGQFENLAVAEESIYRLKSQGKTGFYFDESGP
      gas57M12_20069  (799)  RDSQDDQLNRVNIPFVGFKGQFENLAVAEESIYRLKSQGKTGFYFDESGP
      gas57M12_22432  (799)  RDSQDDQLNRVNIPFVGFKGQFENLAVAEESIYRLKSQGKTGFYFDESGP
      gas57M4_40499   (799)  RDSQDDQLNRVNIPFVGFKGQFENLAVAEESIYRLKSQGKTGFYFDESGP
     gas57M6,1_21259  (799)  RDSQDDQLNRVNIPFVGFKGQFENLAVAEESIYRLKSQGKTGFYFDESGP
```

FIG. 10R

```
                          851                                             900
     gas57M1_SF370   (849) KDDIYVGKHFTGLVTLGSETNVSTKTISDNGLHTLGTFKNADGKFILEKN
     gas57M1_31075  (849) KDDIYVGKHFTGLVTLGSETNVSTKTISDNGLHTLGTFKNADGKFILEKN
     gas57M1_31237  (849) KDDIYVGKHFTGLVTLGSETNVSTKTISDNGLHTLGTFKNADGKFILEKN
      gas57M1_3348  (849) KDDIYVGKHFTGLVTLGSETNVSTKTISDNGLHTLGTFKNADGKFILEKN
     gas57M2_34585  (849) KDDIYVGKHFTGLVTLGSETNVSTKTISDNGLHTLGTFKNADGKFILEKN
   gas57M3,1_21398  (849) KDDIYVGKHFTGLVTLGSETNVSTKTISDNGLHTLGTFKNADGKFILEKN
  gas57M44-61_20839 (849) KDDIYVGKHFTGLVTLGSETNVSTKTISDNGLHTLGTFKNADGKFILEKN
   gas57M6,31_20022 (848) KDDIYVGKHFTGLVTLGSETNVSTKTISDNGLHTLGTFKNADGKFILEKN
     gas57M11_20648 (847) KDDIYVGKHFTGLVTLGSETNVSTKTISDNGLHTLGTFKNADGKFILEKN
      gas57M23_2071 (848) KDDIYVGKHFTGLVTLGSETNVSTKTISDNGLHTLGTFKNADGKFILEKN
   gas57M18,3_40128 (849) KDDIYVGKHFTGLVTLGSETNVSTKTISDNGLHTLGTFKNADGKFILEKN
     gas57M4_10092  (849) KDDIYVGKHFTGLVTLGSETNVSTKTISDNGLHTLGTFKNADGKFILEKN
     gas57M4_30968  (849) KDDIYVGKHFTGLVTLGSETNVSTKTISDNGLHTLGTFKNADGKFILEKN
   gas57M6,31_22692 (849) KDDIYVGKHFTGLVTLGSETNVSTKTISDNGLHTLGTFKNADGKFILEKN
   gas57M68,5_22814 (848) KDDIYVGKHFTGLVTLGSETNVSTKTISDNGLHTLGTFKNADGKFILEKN
     gas57M68_23623 (849) KDDIYVGKHFTGLVTLGSETNVSTKTISDNGLHTLGTFKNADGKFILEKN
     gas57M2_10064  (847) KDDIYVGKHFTGLVTLGSETNVSTKTISDNGLHTLGTFKNADGKFILEKN
     gas57M2_10065  (847) KDDIYVGKHFTGLVTLGSETNVSTKTISDNGLHTLGTFKNADGKFILEKN
     gas57M77_10251 (847) KDDIYVGKHFTGLVTLGSETNVSTKTISDNGLHTLGTFKNADGKFILEKN
     gas57M77_10527 (847) KDDIYVGKHFTGLVTLGSETNVSTKTISDNGLHTLGTFKNADGKFILEKN
     gas57M77_20696 (847) KDDIYVGKHFTGLVTLGSETNVSTKTISDNGLHTLGTFKNADGKFILEKN
     gas57M89_21915 (849) KDDIYVGKHFTGLVTLGSETNVSTKTISDNGLHTLGTFKNADGKFILEKN
     gas57M89_23717 (849) KDDIYVGKHFTGLVTLGSETNVSTKTISDNGLHTLGTFKNADGKFILEKN
     gas57M94_10134 (847) KDDIYVGKHFTGLVTLGSETNVSTKTISDNGLHTLGTFKNADGKFILEKN
     gas57M28_10164 (847) KDDIYVGKHFTGLVTLGSETNVSTKTISDNGLHTLGTFKNADGKFILEKN
     gas57M28_10218 (847) KDDIYVGKHFTGLVTLGSETNVSTKTISDNGLHTLGTFKNADGKFILEKN
     gas57M28_10266 (847) KDDIYVGKHFTGLVTLGSETNVSTKTISDNGLHTLGTFKNADGKFILEKN
     gas57M28_10299 (847) KDDIYVGKHFTGLVTLGSETNVSTKTISDNGLHTLGTFKNADGKFILEKN
     gas57M28_30176 (847) KDDIYVGKHFTGLVTLGSETNVSTKTISDNGLHTLGTFKNADGKFILEKN
     gas57M28_30574 (847) KDDIYVGKHFTGLVTLGSETNVSTKTISDNGLHTLGTFKNADGKFILEKN
    gas57M6,9_21802 (850) KDDIYVGKHFTGLVTLGSETNVSTKTISDNGLHTLGTFKNADGKFILEKN
     gas57M75_10012 (851) KDDIYVGKHFTGLVTLGSETNVSTKTISDNGLHTLGTFKNADGKFILEKN
     gas57M75_20671 (851) KDDIYVGKHFTGLVTLGSETNVSTKTISDNGLHTLGTFKNADGKFILEKN
     gas57M75_30603 (851) KDDIYVGKHFTGLVTLGSETNVSTKTISDNGLHTLGTFKNADGKFILEKN
     gas57M75_30207 (851) KDDIYVGKHFTGLVTLGSETNVSTKTISDNGLHTLGTFKNADGKFILEKN
     gas57M22_20641 (850) KDDIYVGKHFTGLVTLGSETNVSTKTISDNGLHTLGTFKNADGKFILEKN
     gas57M22_23465 (850) KDDIYVGKHFTGLVTLGSETNVSTKTISDNGLHTLGTFKNADGKFILEKN
   gas57M3,1_30610  (850) KDDIYVGKHFTGLVTLGSETNVSTKMISDNGLHTLGTFKNADGKFILEKN
   gas57M3,1_40603  (850) KDDIYVGKHFTGLVTLGSETNVSTKMISDNGLHTLGTFKNADGKFILEKN
  gas57M3,28_24214  (850) KDDIYVGKHFTGLVTLGSETNVSTKMISDNGLHTLGTFKNADGKFILEKN
  gas57M3,34_10307  (850) KDDIYVGKHFTGLVTLGSETNVSTKMISDNGLHTLGTFKNADGKFILEKN
     gas57M4_40427  (850) KDDIYVGKHFTGLVTLGSETNVSTKMISDNGLHTLGTFKNADGKFILEKN
      gas57M3_2721  (850) KDDIYVGKHFTGLVTLGSETNVSTKMISDNGLHTLGTFKNADGKFILEKN
     gas57M12_10296 (849) KDDIYVGKHFTGLVTLGSETNVSTKTISDNGLHTLGTFKNADGKFILEKN
     gas57M12_10035 (849) KDDIYVGKHFTGLVTLGSETNVSTKTISDNGLHTLGTFKNVDGKFILEKN
     gas57M12_20069 (849) KDDIYVGKHFTGLVTLGSETNVSTKTISDNGLHTLGTFKNVDGKFILEKN
     gas57M12_22432 (849) KDDIYVGKHFTGLVTLGSETNVSTKTISDNGLHTLGTFKNVDGKFILEKN
     gas57M4_40499  (849) KDDIYVGKHFTGLVTLGSETNVSTKTISDNGLHTLGTFKNVDGKFILEKN
   gas57M6,1_21259  (849) KDDIYVGKHFTGLVTLGSETNVSTKTISDNGLHTLGTFKNVDGKFILEKN
```

FIG. 10S

```
                          901                                                 950
    gas57M1_SF370   (899) AQGNPVLAISPNGDNNQDFAAFKGVFLRKYQGLKASVYHASDKEHKNPLW
    gas57M1_31075   (899) AQGNPVLAISPNGDNNQDFAAFKGVFLRKYQGLKASVYHASDKEHKNPLW
    gas57M1_31237   (899) AQGNPVLAISPNGDNNQDFAAFKGVFLRKYQGLKASVYHASDKEHKNPLW
     gas57M1_3348   (899) AQGNPVLAISPNGDNNQDFAAFKGVFLRKYQGLKASVYHASDKEHKNPLW
    gas57M2_34585   (899) AQGNPVLAISPNGDNNQDFAAFKGVFLRKYQGLKASVYHASDKEHKNPLW
   gas57M3,1_21398  (899) AQGNPVLAISPNGDNNQDFAAFKGVFLRKYQGLKASVYHASDKEHKNPLW
 gas57M44-61_20839  (899) AQGNPVLAISPNGDNNQDFAAFKGVFLRKYQGLKASVYHASDKEHKNPLW
   gas57M6,31_20022 (898) AQGNPVLAISPNGDNNQDFAAFKGVFLRKYQGLKASVYHASDKEHKNPLW
    gas57M11_20648  (897) AQGNPVLAISPNGDNNQDFAAFKGVFLRKYQGLKASVYHASDKEHKNPLW
     gas57M23_2071  (898) AQGNPVLAISPNGDNNQDFAAFKGVFLRKYQGLKASVYHASDKEHKNPLW
   gas57M18,3_40128 (899) AQGNPVLAISPNGDNNQDFAAFKGVFLRKYQGLKASVYHASDKEHKNPLW
    gas57M4_10092   (899) AQGNPVLAISPNGDNNQDFAAFKGVFLRKYQGLKASVYHASDKEHKNPLW
    gas57M4_30968   (899) AQGNPVLAISPNGDNNQDFAAFKGVFLRKYQGLKASVYHASDKEHKNPLW
   gas57M6,31_22692 (899) AQGNPVLAISPNGDNNQDFAAFKGVFLRKYQGLKASVYHASDKEHKNPLW
   gas57M68,5_22814 (898) AQGNPVLAISPNGDNNQDFAAFKGVFLRKYQGLKASVYHASDKEHKNPLW
    gas57M68_23623  (899) AQGNPVLAISPNGDNNQDFAAFKGVFLRKYQGLKASVYHASDKEHKNPLW
    gas57M2_10064   (897) AQGNPVLAISPNGDNNQDFAAFKGVFLRKYQGLKASVYHASDKEHKNPLW
    gas57M2_10065   (897) AQGNPVLAISPNGDNNQDFAAFKGVFLRKYQGLKASVYHASDKEHKNPLW
    gas57M77_10251  (897) AQGNPVLAISPNGDNNQDFAAFKGVFLRKYQGLKASVYHASDKEHKNPLW
    gas57M77_10527  (897) AQGNPVLAISPNGDNNQDFAAFKGVFLRKYQGLKASVYHASDKEHKNPLW
    gas57M77_20696  (897) AQGNPVLAISPNGDNNQDFAAFKGVFLRKYQGLKASVYHASDKEHKNPLW
    gas57M89_21915  (899) AQGNPVLAISPNGDNNQDFAAFKGVFLRKYQGLKASVYHASDKEHKNPLW
    gas57M89_23717  (899) AQGNPVLAISPNGDNNQDFAAFKGVFLRKYQGLKASVYHASDKEHKNPLW
    gas57M94_10134  (897) AQGNPVLAISPNGDNNQDFAAFKGVFLRKYQGLKASVYHASDKEHKNPLW
    gas57M28_10164  (897) AQGNPVLAISPNGDNNQDFAAFKGVFLRKYQGLKASVYHASDKEHKNPLW
    gas57M28_10218  (897) AQGNPVLAISPNGDNNQDFAAFKGVFIRKYQGLKASVYHASDKEHKNPLW
    gas57M28_10266  (897) AQGNPVLAISPNGDNNQDFAAFKGVFLRKYQGLKASVYHASDKEHKNPLW
    gas57M28_10299  (897) AQGNPVLAISPNGDNNQDFAAFKGVFLRKYQGLKASVYHASDKEHKNPLW
    gas57M28_30176  (897) AQGNPVLAISPNGDNNQDFAAFKGVFLRKYQGLKASVYHASDKEHKNPLW
    gas57M28_30574  (897) AQGNPVLAISPNGDNNQDFAAFKGVFLRKYQGLKASVYHASDKEHKNPLW
   gas57M6,9_21802  (900) AQGNPVLAISPNGDNNQDFAAFKGVFLRKYQGLKASVYHASDKEHKNPLW
    gas57M75_10012  (901) AQGNPVLAISPNGDNNQDFAAFKGVFLRKYQGLKASVYHASDKEHKNPLW
    gas57M75_20671  (901) AQGNPVLAISPNGDNNQDFAAFKGVFLRKYQGLKASVYHASDKEHKNPLW
    gas57M75_30603  (901) AQGNPVLAISPNGDNNQDFAAFKGVFLRKYQGLKASVYHASDKEHKNPLW
    gas57M75_30207  (901) AQGNPVLAISPNGDNNQDFAAFKGVFLRKYQGLKASVYHASDKEHKNPLW
    gas57M22_20641  (900) AQGNPVLAISPNGDNNQDFAAFKGVFLRKYQGLKASVYHASDKEHKNPLW
    gas57M22_23465  (900) AQGNPVLAISPNGDNNQDFAAFKGVFLRKYQGLKASVYHASDKEHKNPLW
   gas57M3,1_30610  (900) AQGNPVLAISPNGDNNQDFAAFKGVFLRKYQGLKASVYHASDKEHKNPLW
   gas57M3,1_40603  (900) AQGNPVLAISPNGDNNQDFAAFKGVFLRKYQGLKASVYHASDKEHKNPLW
  gas57M3,28_24214  (900) AQGNPVLAISPNGDNNQDFAAFKGVFLRKYQGLKASVYHASDKEHKNPLW
  gas57M3,34_10307  (900) AQGNPVLAISPNGDNNQDFAAFKGVFLRKYQGLKASVYHASDKEHKNPLW
    gas57M4_40427   (900) AQGNPVLAISPNGDNNQDFAAFKGVFLRKYQGLKASVYHASDKEHKNPLW
     gas57M3_2721   (900) AQGNPVLAISPNGDNNQDFAAFKGVFLRKYQGLKASVYHASDKEHKNPLW
    gas57M12_10296  (899) AQGNPVLAISPNGDNNQDFAAFKGVFLRKYQGLKASVYHASDKEHKNPLW
    gas57M12_10035  (899) AQGNPVLAISPNGDNNQDFAAFKGVFLRKYQGLKASVYHASDKEHKNPLW
    gas57M12_20069  (899) AQGNPVLAISPNGDNNQDFAAFKGVFLRKYQGLKASVYHASDKEHKNPLW
    gas57M12_22432  (899) AQGNPVLAISPNGDNNQDFAAFKGVFLRKYQGLKASVYHASDKEHKNPLW
    gas57M4_40499   (899) AQGNPVLAISPNGDNNQDFAAFKGVFLRKYQGLKASVYHASDKEHKNPLW
   gas57M6,1_21259  (899) AQGNPVLAISPNGDNNQDFAAFKGVFLRKYQGLKASVYHASDKEHKNPLW
```

FIG. 10T

```
                        951                                          1000
gas57M1_SF370     (949) VSPESFKGDKNFNSDIRFAKSTTLLGTAFSGKSLTGAELPDGHYHYVVSY
gas57M1_31075     (949) VSPESFKGDKNFNSDIRFAKSTTLLGTAFSGKSLTGAELPDGHYHYVVSY
gas57M1_31237     (949) VSPESFKGDKNFNSDIRFAKSTTLLGTAFSGKSLTGAELPDGHYHYVVSY
gas57M1_3348      (949) VSPESFKGDKNFNSDIRFAKSTTLLGTAFSGKSLTGAELPDGHYHYVVSY
gas57M2_34585     (949) VSPESFKGDKNFNSDIRFAKSTTLLGTAFSGKSLTGAELPDGHYHYVVSY
gas57M3,1_21398   (949) VSPESFKGDKNFNSDIRFAKSTTLLGTAFSGKSLTGAELPDGYYHYVVSY
gas57M44-61_20839 (949) VSPESFKGDKNFNSDIRFAKSTTLLGTAFSGKSLTGAELPDGYYHYVVSY
gas57M6,31_20022  (948) VSPESFKGDKNFNSDIRFAKSTTLLGTAFSGKSLTGAELPDGYYHYVVSY
gas57M11_20648    (947) VSPESFKGDKNFNSDIRFAKSTTLLGTAFSGKSLTGAELPDGHYHYVVSY
gas57M23_2071     (948) VSPESFKGDKNFNSDIRFAKSTTLLGTAFSGKSLTGAELPDGYYHYVVSY
gas57M18,3_40128  (949) VSPESFKGDKNFNSDIRFAKSTTLLGTAFSGKSLTGAELPDGYYHYVVSY
gas57M4_10092     (949) VSPESFKGDKNFNSDIRFAKSTTLLGTAFSGKSLTGAELPDGYYHYVVSY
gas57M4_30968     (949) VSPESFKGDKNFNSDIRFAKSTTLLGTAFSGKSLTGAELPDGYYHYVVSY
gas57M6,31_22692  (949) VSPESFKGDKNFNSDIRFAKSTTLLGTAFSGKSLTGAELPDGYYHYVVSY
gas57M68,5_22814  (948) VSPESFKGDKNFNSDIRFAKSTTLLGTAFSGKSLTGAELPDGYYHYVVSY
gas57M68_23623    (949) VSPESFKGDKNFNSDIRFAKSTTLLGTAFSGKSLTGAELPDGYYHYVVSY
gas57M2_10064     (947) VSPESFKGDKNFNSDIRFAKSTTLLGTAFSGKSLTGAELPDGYYHYVVSY
gas57M2_10065     (947) VSPESFKGDKNFNSDIRFAKSTTLLGTAFSGKSLTGAELPDGYYHYVVSY
gas57M77_10251    (947) VSPESFKGDKNFNSDIRFAKSTTLLGTAFSGKSLTGAELPDGYYHYVVSY
gas57M77_10527    (947) VSPESFKGDKNFNSDIRFAKSTTLLGTAFSGKSLTGAELPDGYYHYVVSY
gas57M77_20696    (947) VSPESFKGDKNFNSDIRFAKSTTLLGTAFSGKSLTGAELPDGYYHYVVSY
gas57M89_21915    (949) VSPESFKGDKNFNSDIRFAKSTTLLGTAFSGKSLTGAELPDGYYHYVVSY
gas57M89_23717    (949) VSPESFKGDKNFNSDIRFAKSTTLLGTAFSGKSLTGAELPDGYYHYVVSY
gas57M94_10134    (947) VSPESFKGDKNFNSDIRFAKSTTLLGTAFSGKSLTGAELPDGYYHYVVSY
gas57M28_10164    (947) VSPESFKGDKNFNSDIRFAKSTTLLGTAFSGKSLTGAELPDGYYHYVVSY
gas57M28_10218    (947) VSPESFKGDKNFNSDIRFAKSTTLLGTAFSGKSLTGAELPDGYYHYVVSY
gas57M28_10266    (947) VSPESFKGDKNFNSDIRFAKSTTLLGTAFSGKSLTGAELPDGYYHYVVSY
gas57M28_10299    (947) VSPESFKGDKNFNSDIRFAKSTTLLGTAFSGKSLTGAELPDGYYHYVVSY
gas57M28_30176    (947) VSPESFKGDKNFNSDIRFAKSTTLLGTAFSGKSLTGAELPDGYYHYVVSY
gas57M28_30574    (947) VSPESFKGDKNFNSDIRFAKSTTLLGTAFSGKSLTGAELPDGYYHYVVSY
gas57M6,9_21802   (950) VSPESFKGDKNFNSDIRFAKSTTLLGTAFSGKSLTGAELPDGYYHYVVSY
gas57M75_10012    (951) VSPESFKGDKNFNSDIRFAKSTTLLGTAFSGKSLTGAELPDGYYHYVVSY
gas57M75_20671    (951) VSPESFKGDKNFNSDIRFAKSTTLLGTAFSGKSLTGAELPDGYYHYVVSY
gas57M75_30603    (951) VSPESFKGDKNFNSDIRFAKSTTLLGTAFSGKSLTGAELPDGYYHYVVSY
gas57M75_30207    (951) VSPESFKGDKNFNSDIRFAKSTTLLGTAFSGKSLTGAELPDGYYHYVVSY
gas57M22_20641    (950) VSPESFKGDKNFNSDIRFAKSTTLLGTAFSGKSLTGAELPDGHYHYVVSY
gas57M22_23465    (950) VSPESFKGDKNFNSDIRFAKSTTLLGTAFSGKSLTGAELPDGHYHYVVSY
gas57M3,1_30610   (950) VSPESFKGDKNFNSDIRFAKSTTLLGTAFSGKSLTGAELPDGYYHYVVSY
gas57M3,1_40603   (950) VSPESFKGDKNFNSDIRFAKSTTLLGTAFSGKSLTGAELPDGYYHYVVSY
gas57M3,28_24214  (950) VSPESFKGDKNFNSDIRFAKSTTLLGTAFSGKSLTGAELPDGYYHYVVSY
gas57M3,34_10307  (950) VSPESFKGDKNFNSDIRFAKSTTLLGTAFSGKSLTGAELPDGYYHYVVSY
gas57M4_40427     (950) VSPESFKGDKNFNSDIRFAKSTTLLGTAFSGKSLTGAELPDGYYHYVVSY
gas57M3_2721      (950) VSPESFKGDKNFNSDIRFAKSTTLLGTAFSGKSLTGAELPDGYYHYVVSY
gas57M12_10296    (949) VSPESFKGDKNFNSDIRFAKSTTLLGTAFSGKSLTGAELPDGYYHYVVSY
gas57M12_10035    (949) VSPESFKGDKNFNSDIRFAKSTTLLGTAFSGKSLTGAELPDGYYHYVVSY
gas57M12_20069    (949) VSPESFKGDKNFNSDIRFAKSTTLLGTAFSGKSLTGAELPDGYYHYVVSY
gas57M12_22432    (949) VSPESFKGDKNFNSDIRFAKSTTLLGTAFSGKSLTGAELPDGYYHYVVSY
gas57M4_40499     (949) VSPESFKGDKNFNSDIRFAKSTTLLGTAFSGKSLTGAELPDGYYHYVVSY
gas57M6,1_21259   (949) VSPESFKGDKNFNSDIRFAKSTTLLGTAFSGKSLTGAELPDGYYHYVVSY
```

FIG. 10U

```
                         1001                                               1050
gas57M1_SF370     (999)  YPDVVGAKRQEMTFDMILDRQKPVLSQATFDPETNRFKPEPLKDRGLAGV
gas57M1_31075     (999)  YPDVVGAKRQEMTFDMILDRQKPVLSQATFDPETNRFKPEPLKDRGLAGV
gas57M1_31237     (999)  YPDVVGAKRQEMTFDMILDRQKPVLSQATFDPETNRFKPEPLKDRGLAGV
gas57M1_3348      (999)  YPDVVGAKRQEMTFDMILDRQKPVLSQATFDPETNRFKPEPLKDRGLAGV
gas57M2_34585     (999)  YPDVVGAKRQEMTFDMILDRQKPVLSQATFDPETNRFKPEPLKDRGLAGV
gas57M3,1_21398   (999)  YPDVVGAKRQEMTFDMILDRQKPVLSQATFDPETNRFKPEPLKDRGLAGV
gas57M44-61_20839 (999)  YPDVVGAKRQEMTFDMILDRQKPVLSQATFDPETNRFKPEPLKDRGLAGV
gas57M6,31_20022  (998)  YPDVVGAKRQEMTFDMILDRQKPVLSQATFDPETNRFKPEPLKDRGLAGV
gas57M11_20648    (997)  YPDVVGAKRQEMTFDMILDRQKPVLSQATFDPETNRFKPEPLKDRGLAGV
gas57M23_2071     (998)  YPDVVGAKRQEMTFDMILDRQKPVLSQATFDPETNRFKPEPLKDRGLAGV
gas57M18,3_40128  (999)  YPDVVGAKRQEMTFDMILDRQKPVLSQATFDPETNRFKPEPLKDRGLAGV
gas57M4_10092     (999)  YPDVVGAKRQEMTFDMILDRQKPVLSQATFDPETNRFKPEPLKDRGLAGV
gas57M4_30968     (999)  YPDVVGAKRQEMTFDMILDRQKPVLSQATFDPETNRFKPEPLKDRGLAGV
gas57M6,31_22692  (999)  YPDVVGAKRQEMTFDMILDRQKPVLSQATFDPETNRFKPEPLKDRGLAGV
gas57M68,5_22814  (998)  YPDVVGAKRQEMTFDMILDRQKPVLSQATFDPETNRFKPEPLKDRGLAGV
gas57M68_23623    (999)  YPDVVGAKRQEMTFDMILDRQKPVLSQATFDPETNRFKPEPLKDRGLAGV
gas57M2_10064     (997)  YPDVVGAKRQEMTFDMILDRQKPVLSQATFDPETNRFKPEPLKDRGLAGV
gas57M2_10065     (997)  YPDVVGAKRQEMTFDMILDRQKPVLSQATFDPETNRFKPEPLKDRGLAGV
gas57M77_10251    (997)  YPDVVGAKRQEMTFDMILDRQKPVLSQATFDPETNRFKPEPLKDRGLAGV
gas57M77_10527    (997)  YPDVVGAKRQEMTFDMILDRQKPVLSQATFDPETNRFKPEPLKDRGLAGV
gas57M77_20696    (997)  YPDVVGAKRQEMTFDMILDRQKPVLSQATFDPETNRFKPEPLKDRGLAGV
gas57M89_21915    (999)  YPDVVGAKRQEMTFDMILDRQKPVLSQATFDPETNRFKPEPLKDRGLAGV
gas57M89_23717    (999)  YPDVVGAKRQEMTFDMILDRQKPVLSQATFDPETNRFKPEPLKDRGLAGV
gas57M94_10134    (997)  YPDVVGAKRQEMTFDMILDRQKPVLSQATFDPETNRFKPEPLKDRGLAGV
gas57M28_10164    (997)  YPDVVGAKRQEMTFDMILDRQKPVLSQATFDPETNRFKPEPLKDRGLAGV
gas57M28_10218    (997)  YPDVVGAKRQEMTFDMILDRQKPVLSQATFDPETNRFKPEPLKDRGLAGV
gas57M28_10266    (997)  YPDVVGAKRQEMTFDMILDRQKPVLSQATFDPETNRFKPEPLKDRGLAGV
gas57M28_10299    (997)  YPDVVGAKRQEMTFDMILDRQKPVLSQATFDPETNRFKPEPLKDRGLAGV
gas57M28_30176    (997)  YPDVVGAKRQEMTFDMILDRQKPVLSQATFDPETNRFKPEPLKDRGLAGV
gas57M28_30574    (997)  YPDVVGAKRQEMTFDMILDRQKPVLSQATFDPETNRFKPEPLKDRGLAGV
gas57M6,9_21802   (1000) YPDVVGAKRQEMTFDMILDRQKPVLSQATFDPETNRFKPEPLKDRGLAGV
gas57M75_10012    (1001) YPDVVGAKRQEMTFDMILDRQKPVLSQATFDPETNRFKPEPLKDRGLAGV
gas57M75_20671    (1001) YPDVVGAKRQEMTFDMILDRQKPVLSQATFDPETNRFKPEPLKDRGLAGV
gas57M75_30603    (1001) YPDVVGAKRQEMTFDMILDRQKPVLSQATFDPETNRFKPEPLKDRGLAGV
gas57M75_30207    (1001) YPDVVGAKRQEMTFDMILDRQKPVLSQATFDPETNRFKPEPLKDRGLAGV
gas57M22_20641    (1000) YPDVVGAKRQEMTFDMILDRQKPVLSQATFDPETNRFKPEPLKDRGLAGV
gas57M22_23465    (1000) YPDVVGAKRQEMTFDMILDRQKPVLSQATFDPETNRFKPEPLKDRGLAGV
gas57M3,1_30610   (1000) YPDVVGAKRQEMTFDMILDRQKPVLSQATFDPETNRFKPEPLKDRGLAGV
gas57M3,1_40603   (1000) YPDVVGAKRQEMTFDMILDRQKPVLSQATFDPETNRFKPEPLKDRGLAGV
gas57M3,28_24214  (1000) YPDVVGAKRQEMTFDMILDRQKPVLSQATFDPETNRFKPEPLKDRGLAGV
gas57M3,34_10307  (1000) YPDVVGAKRQEMTFDMILDRQKPVLSQATFDPETNRFKPEPLKDRGLAGV
gas57M4_40427     (1000) YPDVVGAKRQEMTFDMILDRQKPVLSQATFDPETNRFKPEPLKDRGLAGV
gas57M3_2721      (1000) YPDVVGAKRQEMTFDMILDRQKPVLSQATFDPETNRFKPEPLKDRGLAGV
gas57M12_10296    (999)  YPDVVGAKRQEMTFDMILDRQKPVLSQATFDPETNRFKPEPLKDRGLAGV
gas57M12_10035    (999)  YPDVVGAKRQEMTFDMILDRQKPVLSQATFDPETNRFKPEPLKDRGLAGV
gas57M12_20069    (999)  YPDVVGAKRQEMTFDMILDRQKPVLSQATFDPETNRFKPEPLKDRGLAGV
gas57M12_22432    (999)  YPDVVGAKRQEMTFDMILDRQKPVLSQATFDPETNRFKPEPLKDRGLAGV
gas57M4_40499     (999)  YPDVVGAKRQEMTFDMILDRQKPVLSQATFDPETNRFKPEPLKDRGLAGV
gas57M6,1_21259   (999)  YPDVVGAKRQEMTFDMILDRQKPVLSQATFDPETNRFKPEPLKDRGLAGV
```

FIG. 10V

```
                              1051                                               1100
  gas57M1_SF370       (1049) RKDSVFYLERKDNKPYTVTINDSYKYVSVEDNKTFVERQADGSFILPLDK
  gas57M1_31075       (1049) RKDSVFYLERKDNKPYTVTINDSYKYVSVEDNKTFVERQADGSFILPLDK
  gas57M1_31237       (1049) RKDSAFYLERKDNKPYTVTINDSYKYVSVEDNKTFVERQADGSFILPLDK
   gas57M1_3348       (1049) RKDSAFYLERKDNKPYTVTINDSYKYVSVEDNKTFVERQADGSFILPLDK
  gas57M2_34585       (1049) RKDSAFYLERKDNKPYTVTINDSYKYVSVEDNKTFVERQADGSFILPLDK
 gas57M3,1_21398      (1049) RKDSVFYLERKDNKPYTVTINDSYKYVSVEDNKTFVERQADGSFILPLDK
gas57M44-61_20839     (1049) RKDSVFYLERKDNKPYIVTINDSYKYVSVEDNKTFVERQADGSFILPLDK
 gas57M6,31_20022     (1048) RKDSVFYLERKDNKPYTVTINDSYKYVSVEDNKTFVERQADGSFILPLDK
  gas57M11_20648      (1047) RKDSVFYLERKDNKPYTVTINDSYKYVSVADNKTFVERQADGSFILPLDK
   gas57M23_2071      (1048) RKDSVFYLERKDNKPYTVTINDSYKYVSVADNKTFVERQADGSFILPLDK
 gas57M18,3_40128     (1049) RKDSVFYLERKDNKPYTVTINDSYKYVSVEDNKTFVERQADGSFILPLDK
  gas57M4_10092       (1049) RKDSVFYLERKDNKPYTVTINDSYKYVSVEDNKTFVERQADGSFILPLDK
  gas57M4_30968       (1049) RKDSVFYLERKDNKPYTVTINDSYKYVSVEDNKTFVERQADGSFILPLDK
 gas57M6,31_22692     (1049) RKDSVFYLERKDNKPYTVTINDSYKYVSVEDNKTFVERQADGSFILPLDK
 gas57M68,5_22814     (1048) RKDSVFYLERKDNKPYTVTINDSYKYVSVEDNKTFVERQADGSFILPLDK
  gas57M68_23623      (1049) RKDSVFYLERKDNKPYTVTINDSYKYVSVEDNKTFVERQADGSFILPLDK
  gas57M2_10064       (1047) RKDSVFYLERKDNKPYTVTINDSYKYVSVADNKTFVERQADGSFILPLDK
  gas57M2_10065       (1047) RKDSVFYLERKDNKPYTVTINDSYKYVSVADNKTFVERQADGSFILPLDK
  gas57M77_10251      (1047) RKDSVFYLERKDNKPYTVTINDSYKYVSVEDNKTFVERQADGSFILPLDK
  gas57M77_10527      (1047) RKDSVFYLERKDNKPYTVTINDSYKYVSVEDNKTFVERQADGSFILPLDK
  gas57M77_20696      (1047) RKDSVFYLERKDNKPYTVTINDSYKYVSVEDNKTFVERQADGSFILPLDK
  gas57M89_21915      (1049) RKDSVFYLERKDNKPYTVTINDSYKYVSVADNKTFVERQADGSFILPLDK
  gas57M89_23717      (1049) RKDSVFYLERKDNKPYTVTINDSYKYVSVADNKTFVERQADGSFILPLDK
  gas57M94_10134      (1047) RKDSVFYLERKDNKPYTVTINDSYKYVSVEDNKTFVERQADGSFILPLDK
  gas57M28_10164      (1047) RKDSVFYLERKDNKPYTVTINDSYKYVSVEDNKTFVERQADGSFILPLDK
  gas57M28_10218      (1047) RKDSVFYLERKDNKPYTVTINDSYKYVSVEDNKTFVERQADGSFILPLDK
  gas57M28_10266      (1047) RKDSVFYLERKDNKPYTVTINDSYKYVSVEDNKTFVERQADGSFILPLDK
  gas57M28_10299      (1047) RKDSVFYLERKDNKPYTVTINDSYKYVSVEDNKTFVERQADGSFILPLDK
  gas57M28_30176      (1047) RKDSVFYLERKDNKPYTVTINDSYKYVSVEDNKTFVERQADGSFILPLDK
  gas57M28_30574      (1047) RKDSVFYLERKDNKPYTVTINDSYKYVSVEDNKTFVERQADGSFILPLDK
 gas57M6,9_21802      (1050) RKDSVFYLERKDNKPYTVTINDSYKYVSVEDNKTFVERQADGSFILPLDK
  gas57M75_10012      (1051) RKDSVFYLERKDNKPYTVTINDSYKYVSVEDNKTFVERQADGSFILPLDK
  gas57M75_20671      (1051) RKDSVFYLKRKDNKPYTVTINDSYKYVSVEDNKTFVERQADGSFILPLDK
  gas57M75_30603      (1051) RKDSVFYLERKDNKPYTVTINDSYKYVSVEDNKTFVERQADGSFILPLDK
  gas57M75_30207      (1051) RKDSVFYLERKDNKPYTVTINDSYKYVSVEDNKTFVERQADGSFILPLDK
  gas57M22_20641      (1050) RKDSVFYLERKDNKPYTVTINDSYKYVSVEDNKTFVERQADGSFILPLDK
  gas57M22_23465      (1050) RKDSVFYLERKDNKPYTVTINDSYKYVSVEDNKTFVERQADGSFILPLDK
 gas57M3,1_30610      (1050) RKDSVFYLERKDNKPYTVTINDSYKYVSVEDSKTFVERQADGSFILPLDK
 gas57M3,1_40603      (1050) RKDSVFYLERKDNKPYTVTINDSYKYVSVEDSKTFVERQADGSFILPLDK
gas57M3,28_24214      (1050) RKDSVFYLERKDNKPYTVTINDSYKYVSVEDSKTFVERQADGSFILPLDK
gas57M3,34_10307      (1050) RKDSVFYLERKDNKPYTVTINDSYKYVSVEDSKTFVERQADGSFILPLDK
  gas57M4_40427       (1050) RKDSVFYLERKDNKPYTVTINDSYKYVSVEDSKTFVERQADGSFILPLDK
   gas57M3_2721       (1050) RKDSVFYLERKDNKPYTVTINDSYKYVSVEDSKTFVERQADGSFILPLDK
  gas57M12_10296      (1049) RKDSVFYLERKDNKPYTVTINDSYKYVSVEDNKTFVERQADGSFILPLDK
  gas57M12_10035      (1049) RKDSVFYLERKDNKPYTVTINDSYKYVSVEDNKTFVERQADGSFILPLDK
  gas57M12_20069      (1049) RKDSVFYLERKDNKPYTVTINDSYKYVSVEDNKTFVERQADGSFILPLDK
  gas57M12_22432      (1049) RKDSVFYLERKDNKPYTVTINDSYKYVSVEDNKTFVERQADGSFILPLDK
  gas57M4_40499       (1049) RKDSVFYLERKDNKPYTVTINDSYKYVSVEDNKTFVERQADGSFILPLDK
 gas57M6,1_21259      (1049) RKDSVFYLERKDNKPYTVTINDSYKYVSVEDNKTFVERQADGSFILPLDK
```

FIG. 10W

```
                               1101                                              1150
    gas57M1_SF370     (1099)   AKLGDFYYMVEDFAGNVAIAKLGDHLPQTLGKTPIKLKLTDGNYQTKETL
     gas57M1_31075    (1099)   AKLGDFYYMVEDFAGNVAIAKLGDHLPQTLGKTPIKLKLTDGNYQTKETL
     gas57M1_31237    (1099)   AKLGDFYYMVEDFAGNVAIAKLGDHLPQTLGKTPIKLKLTDGNYQTKETL
      gas57M1_3348    (1099)   AKLGDFYYMVEDFAGNVAIAKLGDHLPQTLGKTPIKLKLTDGNYQTKETL
     gas57M2_34585    (1099)   AKLGDFYYMVEDFAGNVAIAKLGDHLPQTLGKTPIKLKLTDGNYQTKETL
   gas57M3,1_21398    (1099)   AKLGDFYYMVEDFAGNVAIAKLGDHLPQTLGKTPIKLKLTDGNYQTKETL
  gas57M44-61_20839   (1099)   AKLGDFYYMVEDFAGNVAIAKLGDHLPQTLGKTPIKLKLTDGNYQTKETL
   gas57M6,31_20022   (1098)   AKLGDFYYMVEDFAGNVAIAKLGDHLPQTLGKTPIKLKLTDGNYQTKETL
     gas57M11_20648   (1097)   AKLGDFYYMVEDFAGNVAIAKLGDHLPQTLGKTPIKLKLTDGNYQTKETL
     gas57M23_2071    (1098)   AKLGDFYYMVEDFAGNVAIAKLGDHLPQTLGKTPIKLKLTDGNYQTKETL
   gas57M18,3_40128   (1099)   AKLGDFYYMVEDFAGNVAIAKLGDHLPQTLGKTPIKLKLTDGNYQTKETL
     gas57M4_10092    (1099)   AKLGDFYYMVEDFAGNVAIAKLGDHLPQTLGKTPIKLKLTDGNYQTKETL
     gas57M4_30968    (1099)   AKLGDFYYMVEDFAGNVAIAKLGDHLPQTLGKTPIKLKLTDGNYQTKETL
   gas57M6,31_22692   (1099)   AKLGDFYYMVEDFAGNVAIAKLGDHLPQTLGKTPIKLKLTDGNYQTKETL
   gas57M68,5_22814   (1098)   AKLGDFYYMVEDFAGNVAIAKLGDHLPQTLGKTPIKLKLTDGNYQTKETL
     gas57M68_23623   (1099)   AKLGDFYYMVEDFAGNVAIAKLGDHLPQTLGKTPIKLKLTDGNYQTKETL
     gas57M2_10064    (1097)   AKLGDFYYMVEDFAGNVAIAKLGDHLPQTLGKTPIKLKLTDGNYQTKETL
     gas57M2_10065    (1097)   AKLGDFYYMVEDFAGNVAIAKLGDHLPQTLGKTPIKLKLTDGNYQTKETL
     gas57M77_10251   (1097)   AKLGDFYYMVEDFAGNVAIAKLGDHLPQTLGKTPIKLKLTDGNYQTKETL
     gas57M77_10527   (1097)   AKLGDFYYMVEDFAGNVAIAKLGDHLPQTLGKTPIKLKLTDGNYQTKETL
     gas57M77_20696   (1097)   AKLGDFYYMVEDFAGNVAIAKLGDHLPQTLGKTPIKLKLTDGNYQTKETL
     gas57M89_21915   (1099)   AKLGDFYYMVEDFAGNVAIAKLGDHLPQTLGKTPIKLKLTDGNYQTKETL
     gas57M89_23717   (1099)   AKLGDFYYMVEDFAGNVAIAKLGDHLPQTLGKTPIKLKLTDGNYQTKETL
     gas57M94_10134   (1097)   AKLGDFYYMVEDFAGNVAIAKLGDHLPQTLGKTPIKLKLTDGNYQTKETL
     gas57M28_10164   (1097)   AKLGDFYYMVEDFAGNVAIAKLGDHLPQTLGKTPIKLKLTDGNYQTKETL
     gas57M28_10218   (1097)   AKLGDFYYMVEDFAGNVAIAKLGDHLPQTLGKTPIKLKLTDGNYQTKETL
     gas57M28_10266   (1097)   AKLGDFYYMVEDFAGNVAIAKLGDHLPQTLGKTPIKLKLTDGNYQTKETL
     gas57M28_10299   (1097)   AKLGDFYYMVEDFAGNVAIAKLGDHLPQTLGKTPIKLKLTDGNYQTKETL
     gas57M28_30176   (1097)   AKLGDFYYMVEDFAGNVAIAKLGDHLPQTLGKTPIKLKLTDGNYQTKETL
     gas57M28_30574   (1097)   AKLGDFYYMVEDFAGNVAIAKLGDHLPQTLGKTPIKLKLTDGNYQTKETL
    gas57M6,9_21802   (1100)   AKLGDFYYMVEDFAGNVAIAKLGDHLPQTLGKTPIKLKLTDGNYQTKETL
     gas57M75_10012   (1101)   AKLGDFYYMVEDFAGNVAIAKLGDHLPQTLGKTPIKLKLTDGNYQTKETL
     gas57M75_20671   (1101)   AKLGDFYYMVEDFAGNVAIAKLGDHLPQTLGKTPIKLKLTDGNYQTKETL
     gas57M75_30603   (1101)   AKLGDFYYMVEDFAGNVAIAKLGDHLPQTLGKTPIKLKLTDGNYQTKETL
     gas57M75_30207   (1101)   AKLGDFYYMVEDFAGNVAIAKLGDHLPQTLGKTPIKLKLTDGNYQTKETL
     gas57M22_20641   (1100)   AKLGDFYYMVEDFAGNVAIAKLGDHLPQTLGKTPIKLKLTDGNYQTKETL
     gas57M22_23465   (1100)   AKLGDFYYMVEDFAGNVAIAKLGDHLPQTLGKTPIKLKLTDGNYQTKETL
    gas57M3,1_30610   (1100)   AKLGDFYYMVEDFAGNVAIAKLGDHLPQTLGKTPIKLKLTDGNYQTKETL
    gas57M3,1_40603   (1100)   AKLGDFYYMVEDFAGNVAIAKLGDHLPQTLGKTPIKLKLTDGNYQTKETL
   gas57M3,28_24214   (1100)   AKLGDFYYMVEDFAGNVAIAKLGDHLPQTLGKTPIKLKLTDGNYQTKETL
   gas57M3,34_10307   (1100)   AKLGDFYYMVEDFAGNVAIAKLGDHLPQTLGKTPIKLKLTDGNYQTKETL
     gas57M4_40427    (1100)   AKLGDFYYMVEDFAGNVAIAKLGDHLPQTLGKTPIKLKLTDGNYQTKETL
      gas57M3_2721    (1100)   AKLGDFYYMVEDFAGNVAIAKLGDHLPQTLGKTPIKLKLTDGNYQTKETL
     gas57M12_10296   (1099)   AKLGDFYYMVEDFAGNVAIAKLGDHLPQTLGKTPIKLKLTDGNYQTKETL
     gas57M12_10035   (1099)   AKLGDFYYMVEDFAGNVAIAKLGDHLPQTLGKTPIKLKLTDGNYQTKETL
     gas57M12_20069   (1099)   AKLGDFYYMVEDFAGNVAIAKLGDHLPQTLGKTPIKLKLTDGNYQTKETL
     gas57M12_22432   (1099)   AKLGDFYYMVEDFAGNVAIAKLGDHLPQTLGKTPIKLKLTDGNYQTKETL
     gas57M4_40499    (1099)   AKLGDFYYMVEDFAGNVAIAKLGDHLPQTLGKTPIKLKLTDGNYQTKETL
    gas57M6,1_21259   (1099)   AKLGDFYYMVEDFAGNVAIAKLGDHLPQTLGKTPIKLKLTDGNYQTKETL
```

FIG. 10X

```
                                      1151                                              1200
       gas57M1_SF370   (1149)  KDNLEMTQSDTGLVTNQAQLAVVHRNQPQSQLTKMNQDFFISPNEDGNKD
       gas57M1_31075  (1149)  KDNLEMTQSDTGLVTNQAQLAVVHRNQPQSQLTKMNQDFFISPNEDGNKD
       gas57M1_31237  (1149)  KDNLEMTQSDTGLVTNQAQLAVVHRNQPQSQLTKMNQDFFISPNEDGNKD
        gas57M1_3348  (1149)  KDNLEMTQSDTGLVTNQAQLAVVHRNQPQSQLTKMNQDFFISPNEDGNKD
       gas57M2_34585  (1149)  KDNLEMTQSDTGLVTNQAQLAVVHRNQPQSQLTKMNQDFFISPNEDGNKD
     gas57M3,1_21398  (1149)  KDNLEMTQSDTGLVTNQAQLAVVHRNQPQSQLTKMNQDFFISPNEDGNKD
    gas57M44-61_20839 (1149)  KDNLEMTQSDTGLVTNQAQLAVVHRNQPQSQLTKMNQDFFISPNEDGNKD
     gas57M6,31_20022 (1148)  KDNLEMTQSDTGLVTNQAQLAVVHRNQPQSQLTKMNQDFFISPNEDGNKD
        gas57M11_20648 (1147) KDNLEMTQSDTGLVTNQAQLAVVHRNQPQSQLTKMNQDFFISPNEDGNKD
        gas57M23_2071  (1148) KDNLEMTQSDTGLVTNQAQLAVVHRNQPQSQLTKMNQDFFISPNEDGNKD
    gas57M18,3_40128  (1149)  KDNLEMTQSDTGLVTNQAQLAVVHRNQPQSQLTKMNQDFFISPNEDGNKD
       gas57M4_10092  (1149)  KDNLEMTQSDTGLVTNQAQLAVVHRNQPQSQLTKMNQDFFISPNEDGNKD
       gas57M4_30968  (1149)  KDNLEMTQSDTGLVTNQAQLAVVHRNQPQSQLTKMNQDFFISPNEDGNKD
     gas57M6,31_22692 (1149)  KDNLEMTQSDTGLVTNQAQLAVVHRNQPQSQLTKMNQDFFISPNEDGNKD
     gas57M68,5_22814 (1148)  KDNLEMTQSDTGLVTNQAQLAVVHRNQPQSQLTKMNQDFFISPNEDGNKD
       gas57M68_23623 (1149)  KDNLEMTQSDTGLVTNQAQLAVVHRNQPQSQLTKMNQDFFISPNEDGNKD
        gas57M2_10064 (1147)  KDNLEMTQSDTGLVTNQAQLAVVHRNQPQSQLTKMNQDFFISPNEDGNKD
        gas57M2_10065 (1147)  KDNLEMTQSDTGLVTNQAQLAVVHRNQPQSQLTKMNQDFFISPNEDGNKD
       gas57M77_10251 (1147)  KDNLEMTQSDTGLVTNQAQLAVVHRNQPQSQLTKMNQDFFISPNEDGNKD
       gas57M77_10527 (1147)  KDNLEMTQSDTGLVTNQAQLAVVHRNQPQSQLTKMNQDFFISPNEDGNKD
       gas57M77_20696 (1147)  KDNLEMTQSDTGLVTNQAQLAVVHRNQPQSQLTKMNQDFFISPNEDGNKD
       gas57M89_21915 (1149)  KDNLEMTQSDTGLVTNQAQLAVVHRNQPQSQLTKMNQDFFISPNEDGNKD
       gas57M89_23717 (1149)  KDNLEMTQSDTGLVTNQAQLAVVHRNQPQSQLTKMNQDFFISPNEDGNKD
       gas57M94_10134 (1147)  KDNLEMTQSDTGLVTNQAQLAVVHRNQPQSQLTKMNQDFFISPNEDGNKD
       gas57M28_10164 (1147)  KDNLEMTQSDTGLVTNQAQLAVVHRNQPQSQLTKMNQDFFISPNEDGNKD
       gas57M28_10218 (1147)  KDNLEMTQSDTGLVTNQAQLAVVHRNQPQSQLTKMNQDFFISPNEDGNKD
       gas57M28_10266 (1147)  KDNLEMTQSDTGLVTNQAQLAVVHRNQPQSQLTKMNQDFFISPNEDGNKD
       gas57M28_10299 (1147)  KDNLEMTQSDTGLVTNQAQLAVVHRNQPQSQLTKMNQDFFISPNEDGNKD
       gas57M28_30176 (1147)  KDNLEMTQSDTGLVTNQAQLAVVHRNQPQSQLTKMNQDFFISPNEDGNKD
       gas57M28_30574 (1147)  KDNLEMTQSDTGLVTNQAQLAVVHRNQPQSQLTKMNQDFFISPNEDGNKD
      gas57M6,9_21802 (1150)  KDNLEMTQSDTGLVTNQAQLAVVHRNQPQSQLTKMNQDFFISPNEDGNKD
       gas57M75_10012 (1151)  KDNLEMTQSDTGLVTNQAQLAVVHRNQPQSQLTKMNQDFFISPNEDGNKD
       gas57M75_20671 (1151)  KDNLEMTQSDTGLVTNQAQLAVVHRNQPQSQLTKMNQDFFISPNEDGNKD
       gas57M75_30603 (1151)  KDNLEMTQSDTGLVTNQAQLAVVHRNQPQSQLTKMNQDFFISPNEDGNKD
       gas57M75_30207 (1151)  KDNLEMTQSDTGLVTNQAQLAVVHRNQPQSQLTKMNQDFFISPNEDGNKD
       gas57M22_20641 (1150)  KDNLEMTQSDTGLVTNQAQLAVVHRNQPQSQLTKMNQDFFISPNEDGNKD
       gas57M22_23465 (1150)  KDNLEMTQSDTGLVTNQAQLAVVHRNQPQSQLTKMNQDFFISPNEDGNKD
     gas57M3,1_30610  (1150)  KDNLEMTQSDTGLVTNQAQLAVVHRNQPQSQLTKMNQDFFISPNEDGNKD
     gas57M3,1_40603  (1150)  KDNLEMTQSDTGLVTNQAQLAVVHRNQPQSQLTKMNQDFFISPNEDGNKD
    gas57M3,28_24214  (1150)  KDNLEMTQSDTGLVTNQAQLAVVHRNQPQSQLTKMNQDFFISPNEDGNKD
    gas57M3,34_10307  (1150)  KDNLEMTQSDTGLVTNQAQLAVVHRNQPQSQLTKMNQDFFISPNEDGNKD
       gas57M4_40427  (1150)  KDNLEMTQSDTGLVTNQAQLAVVHRNQPQSQLTKMNQDFFISPNEDGNKD
        gas57M3_2721  (1150)  KDNLEMTQSDTGLVTNQAQLAVVHRNQPQSQLTKMNQDFFISPNEDGNKD
       gas57M12_10296 (1149)  KDNLEMTQSDTGLVTNQAQLAVVHRNQPQSQLTKMNQDFFISPNEDGNKD
       gas57M12_10035 (1149)  KDNLEMTQSDTGLVTNQAQLAVVHRNQPQSQLTKMNQDFFISPNEDGNKD
       gas57M12_20069 (1149)  KDNLEMTQSDTGLVTNQAQLAVVHRNQPQSQLTKMNQDFFISPNEDGNKD
       gas57M12_22432 (1149)  KDNLEMTQSDTGLVTNQAQLAVVHRNQPQSQLTKMNQDFFISPNEDGNKD
       gas57M4_40499  (1149)  KDNLEMTQSDTGLVTNQAQLAVVHRNQPQSQLTKMNQDFFISPNEDGNKD
     gas57M6,1_21259  (1149)  KDNLEMTQSDTGLVTNQAQLAVVHRNQPQSQLTKMNQDFFISPNEDGNKD
```

FIG. 10Y

```
                              1201                                              1250
    gas57M1_SF370     (1199)  FVAFKGLKNNVYNDLTVNVYAKDDHQKQTPIWSSQAGASVSAIESTAWYG
    gas57M1_31075    (1199)  FVAFKGLKNNVYNDLTVNVYAKDDHQKQTPIWSSQAGASVSAIESTAWYG
    gas57M1_31237    (1199)  FVAFKGLKNNVYNDLTVNVYAKDDHQKQTPIWSSQAGASVSAIESTAWYG
     gas57M1_3348    (1199)  FVAFKGLKNNVYNDLTVNVYAKDDHQKQTPIWSSQAGASVSAIESTAWYG
    gas57M2_34585    (1199)  FVAFKGLKNNVYNDLTVNVYAKDDHQKQTPIWSSQAGASVSAIESTAWYG
  gas57M3,1_21398    (1199)  FVAFKGLKNNVYNDLTVNVYAKDDHQKQTPIWSSQAGASASAIESTAWYG
gas57M44-61_20839    (1199)  FVAFKGLKNNVYNDLTVNVYAKDDHQKQTPIWSSQAGASASAIESTAWYG
   gas57M6,31_20022  (1198)  FVAFKGLKNNVYNDLTVNVYAKDDHQKQTPIWSSQAGASASAIESTAWYG
    gas57M11_20648   (1197)  FVAFKGLKNNVYNDLTVNVYAKDDHQKQTPIWSSQAGASASAIESTAWYG
     gas57M23_2071   (1198)  FVAFKGLKNNVYNDLTVNVYAKDDHQKQTPIWSSQAGASASAIESTAWYG
  gas57M18,3_40128   (1199)  FVAFKGLKNNVYNDLTVNVYAKDDHQKQTPIWSSQAGASASAIESTAWYG
    gas57M4_10092    (1199)  FVAFKGLKNNVYNDLTVNVYAKDDHQKQTPIWSSQAGASASAIESTAWYG
    gas57M4_30968    (1199)  FVAFKGLKNNVYNDLTVNVYAKDDHQKQTPIWSSQAGASASAIESTAWYG
  gas57M6,31_22692   (1199)  FVAFKGLKNNVYNDLTVNVYAKDDHQKQTPIWSSQAGASASAIESTAWYG
  gas57M68,5_22814   (1198)  FVAFKGLKNNVYNDLTVNVYAKDDHQKQTPIWSSQAGASASAIESTAWYG
    gas57M68_23623   (1199)  FVAFKGLKNNVYNDLTVNVYAKDDHQKQTPIWSSQAGASASAIESTAWYG
    gas57M2_10064    (1197)  FVAFKGLKNNVYNDLTVNVYAKDDHQKQTPIWSSQAGASASAIESTAWYG
    gas57M2_10065    (1197)  FVAFKGLKNNVYNDLTVNVYAKDDHQKQTPIWSSQAGASASAIESTAWYG
    gas57M77_10251   (1197)  FVAFKGLKNNVYNDLTVNVYAKDDHQKQTPIWSSQAGASASAIESTAWYG
    gas57M77_10527   (1197)  FVAFKGLKNNVYNDLTVNVYAKDDHQKQTPIWSSQAGASASAIESTAWYG
    gas57M77_20696   (1197)  FVAFKGLKNNVYNDLTVNVYAKDDHQKQTPIWSSQAGASASAIESTAWYG
    gas57M89_21915   (1199)  FVAFKGLKNNVYNDLTVNVYAKDDHQKQTPIWSSQAGASASAIESTAWYG
    gas57M89_23717   (1199)  FVAFKGLKNNVYNDLTVNVYAKDDHQKQTPIWSSQAGASASAIESTAWYG
    gas57M94_10134   (1197)  FVAFKGLKNNVYNDLTVNVYAKDDHQKQTPIWSSQAGASASAIESTAWYG
    gas57M28_10164   (1197)  FVAFKGLKNNVYNDLTVNVYAKDDHQKQTPIWSSQAGASASAIESTAWYG
    gas57M28_10218   (1197)  FVAFKGLKNNVYNDLTVNVYAKDDHQKQTPIWSSQAGASASAIESTAWYG
    gas57M28_10266   (1197)  FVAFKGLKNNVYNDLTVNVYAKDDHQKQTPIWSSQAGASASAIESTAWYG
    gas57M28_10299   (1197)  FVAFKGLKNNVYNDLTVNVYAKDDHQKQTPIWSSQAGASASAIESTAWYG
    gas57M28_30176   (1197)  FVAFKGLKNNVYNDLTVNVYAKDDHQKQTPIWSSQAGASASAIESTAWYG
    gas57M28_30574   (1197)  FVAFKGLKNNVYNDLTVNVYAKDDHQKQTPIWSSQAGASASAIESTAWYG
   gas57M6,9_21802   (1200)  FVAFKGLKNNVYNDLTVNVYAKDDHQKQTPIWSSQAGASASAIESTAWYG
    gas57M75_10012   (1201)  FVAFKGLKNNVYNDLTVNVYAKDDHQKQTPIWSSQAGASASAIESTAWYG
    gas57M75_20671   (1201)  FVAFKGLKNNVYNDLTVNVYAKDDHQKQTPIWSSQAGASASAIESTAWYG
    gas57M75_30603   (1201)  FVAFKGLKNNVYNDLTVNVYAKDDHQKQTPIWSSQAGASASAIESTAWYG
    gas57M75_30207   (1201)  FVAFKGLKNNVYNDLTVNVYAKDDHQKQTPIWSSQAGASASAIESTAWYG
    gas57M22_20641   (1200)  FVAFKGLKNNVYNDLTVNVYAKDDHQKQTPIWSSQAGASASAIESTAWYG
    gas57M22_23465   (1200)  FVAFKGLKNNVYNDLTVNVYAKDDHQKQTPIWSSQAGASASAIESTAWYG
  gas57M3,1_30610    (1200)  FVAFKGLKNNVYNDLTVNVYAKDDHQKQTPIWSSQAGASASAIESTAWYG
  gas57M3,1_40603    (1200)  FVAFKGLKNNVYNDLTVNVYAKDDHQKQTPIWSSQAGASASAIESTAWYG
 gas57M3,28_24214    (1200)  FVAFKGLKNNVYNDLTVNVYAKDDHQKQTPIWSSQAGASASAIESTAWYG
 gas57M3,34_10307    (1200)  FVAFKGLKNNVYNDLTVNVYAKDDHQKQTPIWSSQAGASASAIESTAWYG
    gas57M4_40427    (1200)  FVAFKGLKNNVYNDLTVNVYAKDDHQKQTPIWSSQAGASASAIESTAWYG
     gas57M3_2721    (1200)  FVAFKGLKNNVYNDLTVNVYAKDDHQKQTPIWSSQAGASASAIESTAWYG
    gas57M12_10296   (1199)  FVAFKGLKNNVYNDLTVNVYAKDDHQKQTPIWSSQAGASASAIESTAWYG
    gas57M12_10035   (1199)  FVAFKGLKNNVYNDLTVNVYAKDDHQKQTPIWSSQAGASASAIESTAWYG
    gas57M12_20069   (1199)  FVAFKGLKNNVYNDLTVNVYAKDDHQKQTPIWSSQAGASASAIESTAWYG
    gas57M12_22432   (1199)  FVAFKGLKNNVYNDLTVNVYAKDDHQKQTPIWSSQAGASASAIESTAWYG
    gas57M4_40499    (1199)  FVAFKGLKNNVYNDLTVNVYAKDDHQKQTPIWSSQAGASASAIESTAWYG
  gas57M6,1_21259    (1199)  FVAFKGLKNNVYNDLTVNVYAKDDHQKQTPIWSSQAGASASAIESTAWYG
```

FIG. 10Z

```
                              1251                                              1300
    gas57M1_SF370    (1249)  ITARGSKVMPGDYQYVVTYRDEHGKEHQKQYTISVNDKKPMITQGRFDTI
    gas57M1_31075   (1249)  ITARGSKVMPGDYQYVVTYRDEHGKEHQKQYTISVNDKKPMITQGRFDTI
    gas57M1_31237   (1249)  ITARGSKVMPGDYQYVVTYRDEHGKEHQKQYTISVNDKKPMITQGRFDTI
     gas57M1_3348   (1249)  ITARGSKVMPGDYQYVVTYRDEHGKEHQKQYTISVNDKKPMITQGRFDTI
    gas57M2_34585   (1249)  ITARGSKVMPGDYQYVVTYRDEHGKEHQKQYTISVNDKKPMITQGRFDTI
   gas57M3,1_21398  (1249)  ITARGSKVMPGDYQYVVTYRDEHGKEHQKQYTISVNDKKPMITQGRFDTI
 gas57M44-61_20839  (1249)  ITARGSKVMPGDYQYVVTYRDEHGKEHQKQYTISVNDKKPMITQGRFDTI
   gas57M6,31_20022 (1248)  ITARGSKVMPGDYQYVVTYRDEHGKEHQKQYTISVNDKKPMITQGRFDTI
    gas57M11_20648  (1247)  ITARGSKVMPGDYQYVVTYRDEHGKEHQKQYTISVNDKKPMITQGRFDTI
     gas57M23_2071  (1248)  ITARGSKVMPGDYQYVVTYRDEHGKEHQKQYTISVNDKKPMITQGRFDTI
  gas57M18,3_40128 (1249)  ITARGSKVMPGDYQYVVTYRDEHGKEHQKQYTISVNDKKPMITQGRFDTI
    gas57M4_10092   (1249)  ITARGSKVMPGDYQYVVTYRDEHGKEHQKQYTISVNDKKPMITQGRFDTI
    gas57M4_30968   (1249)  ITARGSKVMPGDYQYVVTYRDEHGKEHQKQYTISVNDKKPMITQGRFDTI
  gas57M6,31_22692 (1249)  ITARGSKVMPGDYQYVVTYRDEHGKEHQKQYTISVNDKKPMITQGRFDTI
   gas57M68,5_22814 (1248) ITARGSKVMPGDYQYVVTYRDEHGKVHQKQYTISVNDKKPMITQGRFDTI
    gas57M68_23623  (1249)  ITARGSKVMPGDYQYVVTYRDEHGKVHQKQYTISVNDKKPMITQGRFDTI
    gas57M2_10064   (1247)  ITARGSKVMPGDYQYVVTYRDEHGKEHQKQYTISVNDKKPMITQGRFDTI
    gas57M2_10065   (1247)  ITARGSKVMPGDYQYVVTYRDEHGKEHQKQYTISVNDKKPMITQGRFDTI
    gas57M77_10251  (1247)  ITARGSKVMPGDYQYVVTYRDEHGKEHQKQYTISVNDKKPMITQGRFDTI
    gas57M77_10527  (1247)  ITARGSKVMPGDYQYVVTYRDEHGKEHQKQYTISVNDKKPMITQGRFDTI
    gas57M77_20696  (1247)  ITARGSKVMPGDYQYVVTYRDEHGKEHQKQYTISVNDKKPMITQGRFDTI
    gas57M89_21915  (1249)  ITARGSKVMPGDYQYVVTYRDEHGKEHQKQYTISVNDKKPMITQGRFDTI
    gas57M89_23717  (1249)  ITARGSKVMPGDYQYVVTYRDEHGKEHQKQYTISVNDKKPMITQGRFDTI
    gas57M94_10134  (1247)  ITARGSKVMPGDYQYVVTYRDEHGKEHQKQYTISVNDKKPMITQGRFDTI
    gas57M28_10164  (1247)  ITARGSKVMPGDYQYVVTYRDEHGKEHQKQYTISVNDKKPMITQGRFDTI
    gas57M28_10218  (1247)  ITARGSKVMPGDYQYVVTYRDEHGKEHQKQYTISVNDKKPMITQGRFDTI
    gas57M28_10266  (1247)  ITARGSKVMPGDYQYVVTYRDEHGKEHQKQYTISVNDKKPMITQGRFDTI
    gas57M28_10299  (1247)  ITARGSKVMPGDYQYVVTYRDEHGKEHQKQYTISVNDKKPMITQGRFDTI
    gas57M28_30176  (1247)  ITARGSKVMPGDYQYVVTYRDEHGKEHQKQYTISVNDKKPMITQGRFDTI
    gas57M28_30574  (1247)  ITARGSKVMPGDYQYVVTYRDEHGKEHQKQYTISVNDKKPMITQGRFDTI
   gas57M6,9_21802 (1250)  ITARGSKVMPGDYQYVVTYRDEHGKEHQKQYTISVNDKKPMITQGRFDTI
    gas57M75_10012  (1251)  ITARGSKVMPGDYQYVVTYRDEHGKVHQKQYTISVNDKKPMITQGRFDTI
    gas57M75_20671  (1251)  ITARGSKVMPGDYQYVVTYRDEHGKVHQKQYTISVNDKKPMITQGRFDTI
    gas57M75_30603  (1251)  ITARGSKVMPGDYQYVVTYRDEHGKVHQKQYTISVNDKKPMITQGRFDTI
    gas57M75_30207  (1251)  ITARGSKVMPGDYQYVVTYRDEHGKVHQKQYTISVNDKKPMITQGRFDTI
    gas57M22_20641  (1250)  ITARGSKVMPGDYQYVVTYRDEHGKEHQKQYTISVNDKKPMITQGRFDTI
    gas57M22_23465  (1250)  ITARGSKVMPGDYQYVVTYRDEHGKEHQKQYTISVNDKKPMITQGRFDTI
   gas57M3,1_30610 (1250)  ITARGSKVMPGDYQYVVTYRDEHGKEHQKQYTISVNDKKPMITQGRFDTI
   gas57M3,1_40603 (1250)  ITARGSKVMPGDYQYVVTYRDEHGKEHQKQYTISVNDKKPMITQGRFDTI
  gas57M3,28_24214 (1250)  ITARGSKVMPGDYQYVVTYRDEHGKEHQKQYTISVNDKKPMITQGRFDTI
  gas57M3,34_10307 (1250)  ITARGSKVMPGDYQYVVTYRDEHGKEHQKQYTISVNDKKPMITQGRFDTI
    gas57M4_40427   (1250)  ITARGSKVMPGDYQYVVTYRDEHGKEHQKQYTISVNDKKPMITQGRFDTI
     gas57M3_2721   (1250)  ITARGSKVMPGDYQYVVTYRDEHGKEHQKQYTISVNDKKPMITQGRFDTI
    gas57M12_10296  (1249)  ITARGSKVMPGDYQYVVTYRDEHGKEHQKQYTISVNDKKPMITQGRFDTI
    gas57M12_10035  (1249)  ITARGSKVMPGDYQYVVTYRDEHGKEHQKQYTISVNDKKPMITQGRFDTI
    gas57M12_20069  (1249)  ITARGSKVMPGDYQYVVTYRDEHGKEHQKQYTISVNDKKPMITQGRFDTI
    gas57M12_22432  (1249)  ITARGSKVMPGDYQYVVTYRDEHGKEHQKQYTISVNDKKPMITQGRFDTI
    gas57M4_40499   (1249)  ITARGSKVMPGDYQYVVTYRDEHGKEHQKQYTISVNDKKPMITQGRFDTI
   gas57M6,1_21259 (1249)  ITARGSKVMPGDYQYVVTYRDEHGKEHQKQYTISVNDKKPMITQGRFDTI
```

FIG. 10AA

```
                              1301                                              1350
    gas57M1_SF370    (1299)  NGVDHFTPDKTKALDSSGIVREEVFYLAKKNGRKFDVTEGKDGITVSDNK
    gas57M1_31075   (1299)  NGVDHFTPDKTKALGSSGIVREEVFYLAKKNGRKFDVTEGKDGITVSDNK
    gas57M1_31237   (1299)  NGVDHFTPDKTKALGSSGIVREEVFYLAKKNGRKFDVTEGKDGITVSDNK
     gas57M1_3348   (1299)  NGVDHFTPDKTKALGSSGIVREEVFYLAKKNGRKFDVTEGKDGITVSDNK
    gas57M2_34585   (1299)  NGVDHFTPDKTKALGSSGIVREEVFYLAKKNGRKFDVTEGKDGITVSDNK
  gas57M3,1_21398   (1299)  NGVDHFTPDKTKALGSSGIVREEVFYLAKKNGRKFDVTEGKDGITVSDNK
  gas57M44-61_20839 (1299)  NGVDHFTPDKTKALGSSGIVREEVFYLAKKNGRKFDVTEGKDGITVSDNK
  gas57M6,31_20022  (1298)  NGVDHFTPDKTKALGSSGIVREEVFYLAKKNGRKFDVTEGKDGITVSDNK
    gas57M11_20648  (1297)  NGVDHFTPDKTKALGSSGIVREEVFYLAKKNGRKFDVTEGKDGITVSDNK
     gas57M23_2071  (1298)  NGVDHFTPDKTKALGSSGIVREEVFYLAKKNGRKFDVTEGKDGITVSDNK
  gas57M18,3_40128  (1299)  NGVDHFTPDKTKALGSSGIVREEVFYLAKKNGRKFDVTEGKDGITVSDNK
    gas57M4_10092   (1299)  NGVDHFTPDKTKALGSSGIVREEVFYLAKKNGRKFDVTEGKDGITVSDNK
    gas57M4_30968   (1299)  NGVDHFTPDKTKALGSSGIVREEVFYLAKKNGRKFDVTEGKDGITVSDNK
  gas57M6,31_22692  (1299)  NGVDHFTPDKTKALGSSGIVREEVFYLAKKNGRKFDVTEGKDGITVSDNK
  gas57M68,5_22814  (1298)  NGVDHFTPDKTKALGSSGIVREEVFYLAKKNGRKFDVTEGKDGITVSDNK
    gas57M68_23623  (1299)  NGVDHFTPDKTKALGSSGIVREEVFYLAKKNGRKFDVTEGKDGITVSDNK
    gas57M2_10064   (1297)  NGVDHFTPDKTKALGSSGIVREEVFYLAKKNGRKFDVTEGKDGITVSDNK
    gas57M2_10065   (1297)  NGVDHFTPDKTKALGSSGIVREEVFYLAKKNGRKFDVTEGKDGITVSDNK
    gas57M77_10251  (1297)  NGVDHFTPDKTKALGSSGIVREEVFYLAKKNGRKFDVTEGKDGITVSDNK
    gas57M77_10527  (1297)  NGVDHFTPDKTKALGSSGIVREEVFYLAKKNGRKFDVTEGKDGITVSDNK
    gas57M77_20696  (1297)  NGVDHFTPDKTKALGSSGIVREEVFYLAKKNGRKFDVTEGKDGITVSDNK
    gas57M89_21915  (1299)  NGVDHFTPDKTKALGSSGIVREEVFYLAKKNGRKFDVTEGKDGITVSDNK
    gas57M89_23717  (1299)  NGVDHFTPDKTKALGSSGIVREEVFYLAKKNGRKFDVTEGKDGITVSDNK
    gas57M94_10134  (1297)  NGVDHFTPDKTKALGSSGIVREEVFYLAKKNGRKFDVTEGKDGITVSDNK
    gas57M28_10164  (1297)  NGVDHFTPDKTKALGSSGIVREEVFYLAKKNGRKFDVTEGKDGITVSDNK
    gas57M28_10218  (1297)  NGVDHFTPDKTKALGSSGIVREEVFYLAKKNGRKFDVTEGKDGITVSDNK
    gas57M28_10266  (1297)  NGVDHFTPDKTKALGSSGIVREEVFYLAKKNGRKFDVTEGKDGITVSDNK
    gas57M28_10299  (1297)  NGVDHFTPDKTKALGSSGIVREEVFYLAKKNGRKFDVTEGKDGITVSDNK
    gas57M28_30176  (1297)  NGVDHFTPDKTKALGSSGIVREEVFYLAKKNGRKFDVTEGKDGITVSDNK
    gas57M28_30574  (1297)  NGVDHFTPDKTKALGSSGIVREEVFYLAKKNGRKFDVTEGKDGITVSDNK
   gas57M6,9_21802  (1300)  NGVDHFTPDKTKALGSSGIVREEVFYLAKKNGRKFDVTEGKDGITVSDNK
    gas57M75_10012  (1301)  NGVDHFTPDKTKALGSSGIVREEVFYLAKKNGRKFDVTEGKDGITVSDNK
    gas57M75_20671  (1301)  NGVDHFTPDKTKALGSSGIVREEVFYLAKKNGRKFDVTEGKDGITVSDNK
    gas57M75_30603  (1301)  NGVDHFTPDKTKALGSSGIVREEVFYLAKKNGRKFDVTEGKDGITVSDNK
    gas57M75_30207  (1301)  NGVDHFTPDKTKALGSSGIVREEVFYLAKKNGRKFDVTEGKDGITVSDNK
    gas57M22_20641  (1300)  NGVDHFTPDKTKALGSSGIVREEVFYLAKKNGRKFDVTEGKDGITVSDNK
    gas57M22_23465  (1300)  NGVDHFTPDKTKALGSSGIVREEVFYLAKKNGRKFDVTEGKDGITVSDNK
  gas57M3,1_30610   (1300)  NGVDHFTPDKTKALGSSGIVREEVFYLAKKNGRKFDVTEGKDGITVSDNK
  gas57M3,1_40603   (1300)  NGVDHFTPDKTKALGSSGIVREEVFYLAKKNGRKFDVTEGKDGITVSDNK
  gas57M3,28_24214  (1300)  NGVDHFTPDKTKALGSSGIVREEVFYLAKKNGRKFDVTEGKDGITVSDNK
  gas57M3,34_10307  (1300)  NGVDHFTPDKTKALGSSGIVREEVFYLAKKNGRKFDVTEGKDGITVSDNK
    gas57M4_40427   (1300)  NGVDHFTPDKTKALGSSGIVREEVFYLAKKNGRKFDVTEGKDGITVSDNK
     gas57M3_2721   (1300)  NGVDHFTPDKTKALGSSGIVREEVFYLAKKNGRKFDVTEGKDGITVSDNK
    gas57M12_10296  (1299)  NGVDHFTPDKTKALGSSGIVREEVFYLAKKNGRKFDVTEGKDGITVSDNK
    gas57M12_10035  (1299)  NGVDHFTPDKTKALGSSGIVREEVFYLAKKNGRKFDVTEGKDGITVSDNK
    gas57M12_20069  (1299)  NGVDHFTPDKTKALGSSGIVREEVFYLAKKNGRKFDVTEGKDGITVSDNK
    gas57M12_22432  (1299)  NGVDHFTPDKTKALGSSGIVREEVFYLAKKNGRKFDVTEGKDGITVSDNK
    gas57M4_40499   (1299)  NGVDHFTPDKTKALGSSGIVREEVFYLAKKNGRKFDVTEGKDGITVSDNK
  gas57M6,1_21259   (1299)  NGVDHFTPDKTKALGSSGIVREEVFYLAKKNGRKFDVTEGKDGITVSDNK
```

FIG. 10BB

```
                                1351                                                 1400
     gas57M1_SF370      (1349)  VYIPKNPDGSYTISKRDGVTLSDYYYLVEDRAGNVSFATLRDLKAVGKDK
     gas57M1_31075     (1349)  VYIPKNPDGSYTISKRDGVTLSDYYYLVEDRAGNVSFATLRDLKAVGKDK
     gas57M1_31237     (1349)  VYIPKNPDGSYTISKRDGVTLSDYYYLVEDRAGNVSFATLRDLKAVGKDK
      gas57M1_3348     (1349)  VYIPKNPDGSYTISKRDGVTLSDYYYLVEDRAGNVSFATLRDLKAVGKDK
     gas57M2_34585     (1349)  VYIPKNPDGSYTISKRDGVTLSDYYYLVEDRAGNVSFATLRDLKAVGKDK
    gas57M3,1_21398    (1349)  VYIPKNPDGSYTISKRDGVTLSDYYYLVEDRAGNVSFATLRDLKAVGKDK
   gas57M44-61_20839   (1349)  VYIPKNPDGSYTISKRDGVTLSDYYYLVEDRAGNVSFATLRDLKAVGKDK
    gas57M6,31_20022   (1348)  VYIPKNPDGSYTISKRDGVTLSDYYYLVEDRAGNVSFATLRDLKAVGKDK
     gas57M11_20648    (1347)  VYIPKNPDGSYTISKRDGVTLSDYYYLVEDRAGNVSFATLRDLKAVGKDK
     gas57M23_2071     (1348)  VYIPKNPDGSYTISKRDGVTLSDYYYLVEDRAGNVSFATLRDLKAVGKDK
   gas57M18,3_40128    (1349)  VYIPKNPDGSYTISKRDGVTLSDYYYLVEDRAGNVSFATLRDLKAVGKDK
      gas57M4_10092    (1349)  VYIPKNPDGSYTISKRDGVTLSDYYYLVEDRAGNVSFATLRDLKAVGKDK
      gas57M4_30968    (1349)  VYIPKNPDGSYTISKRDGVTLSDYYYLVEDRAGNVSFATLRDLKAVGKDK
   gas57M6,31_22692    (1349)  VYIPKNPDGSYTISKRDGVTLSDYYYLVEDRAGNVSFATLRDLKAVGKDK
   gas57M68,5_22814    (1348)  VYIPKNPDGSYTISKRDGVTLSDYYYLVEDRAGNVSFATLRDLKAVGKDK
     gas57M68_23623    (1349)  VYIPKNPDGSYTISKRDGVTLSDYYYLVEDRAGNVSFATLRDLKAVGKDK
     gas57M2_10064     (1347)  VYIPKNPDGSYTISKRDGVTLSDYYYLVEDRAGNVSFATLRDLKAVGKDK
     gas57M2_10065     (1347)  VYIPKNPDGSYTISKRDGVTLSDYYYLVEDRAGNVSFATLRDLKAVGKDK
     gas57M77_10251    (1347)  VYIPKNPDGSYTISKRDGVTLSDYYYLVEDRAGNVSFATLRDLKAVGKDK
     gas57M77_10527    (1347)  VYIPKNPDGSYTISKRDGVTLSDYYYLVEDRAGNVSFATLRDLKAVGKDK
     gas57M77_20696    (1347)  VYIPKNPDGSYTISKRDGVTLSDYYYLVEDRAGNVSFATLRDLKAVGKDK
     gas57M89_21915    (1349)  VYIPKNPDGSYTISKRDGVTLSDYYYLVEDRAGNVSFATLRDLKAVGKDK
     gas57M89_23717    (1349)  VYIPKNPDGSYTISKRDGVTLSDYYYLVEDRAGNVSFATLRDLKAVGKDK
     gas57M94_10134    (1347)  VYIPKNPDGSYTISKRDGVTLSDYYYLVEDRAGNVSFATLRDLKAVGKDK
     gas57M28_10164    (1347)  VYIPKNPDGSYTISKRDGVTLSDYYYLVEDRAGNVSFATLRDLKAVGKDK
     gas57M28_10218    (1347)  VYIPKNPDGSYTISKRDGVTLSDYYYLVEDRAGNVSFATLRDLKAVGKDK
     gas57M28_10266    (1347)  VYIPKNPDGSYTISKRDGVTLSDYYYLVEDRAGNVSFATLRDLKAVGKDK
     gas57M28_10299    (1347)  VYIPKNPDGSYTISKRDGVTLSDYYYLVEDRAGNVSFATLRDLKAVGKDK
     gas57M28_30176    (1347)  VYIPKNPDGSYTISKRDGVTLSDYYYLVEDRAGNVSFATLRDLKAVGKDK
     gas57M28_30574    (1347)  VYIPKNPDGSYTISKRDGVTLSDYYYLVEDRAGNVSFATLRDLKAVGKDK
    gas57M6,9_21802    (1350)  VYIPKNPDGSYTISKRDGVTLSDYYYLVEDRAGNVSFATLRDLKAVGKDK
     gas57M75_10012    (1351)  VYIPKNPDGSYTISKRDGVTLSDYYYLVEDRAGNVSFATLRDLKAVGKDK
     gas57M75_20671    (1351)  VYIPKNPDGSYTISKRDGVTLSDYYYLVEDRAGNVSFATLRDLKAVGKDK
     gas57M75_30603    (1351)  VYIPKNPDGSYTISKRDGVTLSDYYYLVEDRAGNVSFATLRDLKAVGKDK
     gas57M75_30207    (1351)  VYIPKNPDGSYTISKRDGVTLSDYYYLVEDRAGNVSFATLRDLKAVGKDK
     gas57M22_20641    (1350)  VYIPKNPDGSYTISKRDGVTLSDYYYLVEDRAGNVSFATLRDLKAVGKDK
     gas57M22_23465    (1350)  VYIPKNPDGSYTISKRDGVTLSDYYYLVEDRAGNVSFATLRDLKAVGKDK
    gas57M3,1_30610    (1350)  VYIPKNPDGSYTISKRDGVTLSDYYYLVEDRAGNVSFATLRDLKVVGKDK
    gas57M3,1_40603    (1350)  VYIPKNPDGSYTISKRDGVTLSDYYYLVEDRAGNVSFATLRDLKVVGKDK
   gas57M3,28_24214    (1350)  VYIPKNPDGSYTISKRDGVTLSDYYYLVEDRAGNVSFATLRDLKVVGKDK
   gas57M3,34_10307    (1350)  VYIPKNPDGSYTISKRDGVTLSDYYYLVEDRAGNVSFATLRDLKVVGKDK
     gas57M4_40427     (1350)  VYIPKNPDGSYTISKRDGVTLSDYYYLVEDRAGNVSFATLRDLKVVGKDK
      gas57M3_2721     (1350)  VYIPKNPDGSYTISKRDGVTLSDYYYLVEDRAGNVSFATLRDLKVVGKDK
     gas57M12_10296    (1349)  VYIPKNPDGSYTISKRDGVTLSDYYYLVEDRAGNVSFATLRDLKAVGKDK
     gas57M12_10035    (1349)  VYIPKNPDGSYTISKRDGVTLSDYYYLVEDRAGNVSFATLRDLKAVGKDK
     gas57M12_20069    (1349)  VYIPKNPDGSYTISKRDGVTLSDYYYLVEDRAGNVSFATLRDLKAVGKDK
     gas57M12_22432    (1349)  VYIPKNPDGSYTISKRDGVTLSDYYYLVEDRAGNVSFATLRDLKAVGKDK
     gas57M4_40499     (1349)  VYIPKNPDGSYTISKRDGVTLSDYYYLVEDRAGNVSFATLRDLKAVGKDK
    gas57M6,1_21259    (1349)  VYIPKNPDGSYTISKRDGVTLSDYYYLVEDRAGNVSFATLRDLKAVGKDK
```

FIG. 10CC

```
                                   1401                                              1450
      gas57M1_SF370    (1399) AVVNFGLDLPVPEDKQIVNFTYLVRDADGKPIENLEYYNNSGNSLILPYG
      gas57M1_31075   (1399) AVVNFGLDLPVPEDKQIVNFTYLVRDADGKPIENLEYYNNSGNSLILPYG
      gas57M1_31237   (1399) AVVNFGLDLPVPEDKQIVNFTYLVRDADGKPIENLEYYNNSGNSLILPYG
       gas57M1_3348   (1399) AVVNFGLDLPVPEDKQIVNFTYLVRDADGKPIENLEYYNNSGNSLILPYG
      gas57M2_34585   (1399) AVVNFGLDLPVPEDKQIVNFTYLVRDADGKPIENLEYYNNSGNSLILPYG
    gas57M3,1_21398   (1399) AVVNFGLDLPVPEDKQIVNFTYLVRDADGKPIENLEYYNNSGNSLILPYG
   gas57M44-61_20839  (1399) AVVNFGLDLPVPEDKQIVNFTYLVRDADGKPIENLEYYNNSGNSLILPYG
    gas57M6,31_20022  (1398) AVVNFGLDLPVPEDKQIVNFTYLVRDADGKPIENLEYYNNSGNSLILPYG
      gas57M11_20648  (1397) AVVNFGLDLPVPEDKQIVNFTYLVRDADGKPIENLEYYNNSGNSLILPYG
       gas57M23_2071  (1398) AVVNFGLDLPVPEDKQIVNFTYLVRDADGKPIENLEYYNNSGNSLILPYG
    gas57M18,3_40128  (1399) AVVNFGLDLPVPEDKQIVNFTYLVRDADGKPIENLEYYNNSGNSLILPYG
      gas57M4_10092   (1399) AVVNFGLDLPVPEDKQIVNFTYLVRDADGKPIENLEYYNNSGNSLILPYG
      gas57M4_30968   (1399) AVVNFGLDLPVPEDKQIVNFTYLVRDADGKPIENLEYYNNSGNSLILPYG
    gas57M6,31_22692  (1399) AVVNFGLDLPVPEDKQIVNFTYLVRDADGKPIENLEYYNNSGNSLILPYG
    gas57M68,5_22814  (1398) AVVNFGLDLPVPEDKQIVNFTYLVRDADGKPIENLEYYNNSGNSLILPYG
      gas57M68_23623  (1399) AVVNFGLDLPVPEDKQIVNFTYLVRDADGKPIENLEYYNNSGNSLILPYG
      gas57M2_10064   (1397) AVVNFGLDLPVPEDKQIVNFTYLVRDADGKPIENLEYYNNSGNSLILPYG
      gas57M2_10065   (1397) AVVNFGLDLPVPEDKQIVNFTYLVRDADGKPIENLEYYNNSGNSLILPYG
      gas57M77_10251  (1397) AVVNFGLDLPVPEDKQIVNFTYLVRDADGKPIENLEYYNNSGNSLILPYG
      gas57M77_10527  (1397) AVVNFGLDLPVPEDKQIVNFTYLVRDADGKPIENLEYYNNSGNSLILPYG
      gas57M77_20696  (1397) AVVNFGLDLPVPEDKQIVNFTYLVRDADGKPIENLEYYNNSGNSLILPYG
      gas57M89_21915  (1399) AVVNFGLDLPVPEDKQIVNFTYLVRDADGKPIENLEYYNNSGNSLILPYG
      gas57M89_23717  (1399) AVVNFGLDLPVPEDKQIVNFTYLVRDADGKPIENLEYYNNSGNSLILPYG
      gas57M94_10134  (1397) AVVNFGLDLPVPEDKQIVNFTYLVRDADGKPIENLEYYNNSGNSLILPYG
      gas57M28_10164  (1397) AVVNFGLDLPVPEDKQIVNFTYLVRDADGKPIENLEYYNNSGNSLILPYG
      gas57M28_10218  (1397) AVVNFGLDLPVPEDKQIVNFTYLVRDADGKPIENLEYYNNSGNSLILPYG
      gas57M28_10266  (1397) AVVNFGLDLPVPEDKQIVNFTYLVRDADGKPIENLEYYNNSGNSLILPYG
      gas57M28_10299  (1397) AVVNFGLDLPVPEDKQIVNFTYLVRDADGKPIENLEYYNNSGNSLILPYG
      gas57M28_30176  (1397) AVVNFGLDLPVPEDKQIVNFTYLVRDADGKPIENLEYYNNSGNSLILPYG
      gas57M28_30574  (1397) AVVNFGLDLPVPEDKQIVNFTYLVRDADGKPIENLEYYNNSGNSLILPYG
     gas57M6,9_21802  (1400) AVVNFGLDLPVPEDKQIVNFTYLVRDADGKPIENLEYYNNSGNSLILPYG
      gas57M75_10012  (1401) AVVNFGLDLPVPEDKQIVNFTYLVRDADGKPIENLEYYNNSGNSLILPYG
      gas57M75_20671  (1401) AVVNFGLDLPVPEDKQIVNFTYLVRDADGKPIENLEYYNNSGNSLILPYG
      gas57M75_30603  (1401) AVVNFGLDLPVPEDKQIVNFTYLVRDADGKPIENLEYYNNSGNSLILPYG
      gas57M75_30207  (1401) AVVNFGLDLPVPEDKQIVNFTYLVRDADGKPIENLEYYNNSGNSLILPYG
      gas57M22_20641  (1400) AVVNFGLDLPVPEDKQIVNFTYLVRDADGKPIENLEYYNNSGNSLILPYG
      gas57M22_23465  (1400) AVVNFGLDLPVPEDKQIVNFTYLVRDADGKPIENLEYYNNSGNSLILPYG
    gas57M3,1_30610   (1400) AVVNFGLDLPVPEDKQIVNFTYLVRDADGKPIENLEYYNNSGNSLILPYG
    gas57M3,1_40603   (1400) AVVNFGLDLPVPEDKQIVNFTYLVRDADGKPIENLEYYNNSGNSLILPYG
   gas57M3,28_24214   (1400) AVVNFGLDLPVPEDKQIVNFTYLVRDADGKPIENLEYYNNSGNSLILPYG
   gas57M3,34_10307   (1400) AVVNFGLDLPVPEDKQIVNFTYLVRDADGKPIENLEYYNNSGNSLILPYG
      gas57M4_40427   (1400) AVVNFGLDLPVPEDKQIVNFTYLVRDADGKPIENLEYYNNSGNSLILPYG
       gas57M3_2721   (1400) AVVNFGLDLPVPEDKQIVNFTYLVRDADGKPIENLEYYNNSGNSLILPYG
      gas57M12_10296  (1399) AVVNFGLDLPVPEDKQIVNFTYLVRDADGKPIENLEYYNNSGNSLILPYG
      gas57M12_10035  (1399) AVVNFGLDLPVPEDKQIVNFTYLVRDADGKPIENLEYYNNSGNSLILPYG
      gas57M12_20069  (1399) AVVNFGLDLPVPEDKQIVNFTYLVRDADGKPIENLEYYNNSGNSLILPYG
      gas57M12_22432  (1399) AVVNFGLDLPVPEDKQIVNFTYLVRDADGKPIENLEYYNNSGNSLILPYG
      gas57M4_40499   (1399) AVVNFGLDLPVPEDKQIVNFTYLVRDADGKPIENLEYYNNSGNSLILPYG
    gas57M6,1_21259   (1399) AVVNFGLDLPVPEDKQIVNFTYLVRDADGKPIENLEYYNNSGNSLILPYG
```

FIG. 10DD

```
                              1451                                          1500
    gas57M1_SF370    (1449) KYTVELLTYDTNAAKLESDKIVSFTLSADNNFQQVTFKITMLATSQITAH
    gas57M1_31075   (1449) KYTVELLTYDTNAAKLESDKIVSFTLSADNNFQQVTFKITMLATSQITAH
    gas57M1_31237   (1449) KYTVELLTYDTNAAKLESDKIVSFTLSADNNFQQVTFKITMLATSQITAH
     gas57M1_3348   (1449) KYTVELLTYDTNAAKLESDKIVSFTLSADNNFQQVTFKITMLATSQITAH
    gas57M2_34585   (1449) KYTVELLTYDTNAAKLESDKIVSFTLSADNNFQQVTFKITMLATSQITAH
   gas57M3,1_21398  (1449) KYTVELLTYDTNAAKLESDKIVSFTLSADNNFQQVTFKMTMLATSQITAH
 gas57M44-61_20839  (1449) KYTVELLTYDTNAAKLESDKIVSFTLSADNNFQQVTFKMTILATSQITAH
   gas57M6,31_20022 (1448) KYTVELLTYDTNAAKLESDKIVSFTLSADNNFQQVTFKMTMLATSQITAH
    gas57M11_20648  (1447) KYTVELLTYDTNAAKLESDKIVSFTLSADNNFQQVTFKMTMLATSQITAH
    gas57M23_2071   (1448) KYTVELLTYDTNAAKLESDKIVSFTLSADNNFQQVTFKMTMLATSQITAH
  gas57M18,3_40128  (1449) KYTVELLTYDTNAAKLESDKIVSFTLSADNNFQQVTFKMTMLATSQITAH
    gas57M4_10092   (1449) KYTVELLTYDTNAAKLESDKIVSFTLSADNNFQQVTFKMTMLATSQITAH
    gas57M4_30968   (1449) KYTVELLTYDTNAAKLESDKIVSFTLSADNNFQQVTFKMTMLATSQITAH
   gas57M6,31_22692 (1449) KYTVELLTYDTNAAKLESDKIVSFTLSADNNFQQVTFKMTMLATSQITAH
   gas57M68,5_22814 (1448) KYTVELLTYDTNAAKLESDKIVSFTLSADNNFQQVTFKMTMLATSQITAH
    gas57M68_23623  (1449) KYTVELLTYDTNAAKLESDKIVSFTLSADNNFQQVTFKMTMLATSQITAH
    gas57M2_10064   (1447) KYTVELLTYDTNAAKLESDKIVSFTLSADNNFQQVTFKMTMLATSQITAH
    gas57M2_10065   (1447) KYTVELLTYDTNAAKLESDKIVSFTLSADNNFQQVTFKMTMLATSQITAH
    gas57M77_10251  (1447) KYTVELLTYDTNAAKLESDKIVSFTLSADNNFQQVTFKMTMLATSQITAH
    gas57M77_10527  (1447) KYTVELLTYDTNAAKLESDKIVSFTLSADNNFQQVTFKMTMLATSQITAH
    gas57M77_20696  (1447) KYTVELLTYDTNAAKLESDKIVSFTLSADNNFQQVTFKMTMLATSQITAH
    gas57M89_21915  (1449) KYTVELLTYDTNAAKLESDKIVSFTLSADNNFQQVTFKMTMLATSQITAH
    gas57M89_23717  (1449) KYTVELLTYDTNAAKLESDKIVSFTLSADNNFQQVTFKMTMLATSQITAH
    gas57M94_10134  (1447) KYTVELLTYDTNAAKLESDKIVSFTLSADNNFQQVTFKMTMLATSQITAH
    gas57M28_10164  (1447) KYTVELLTYDTNAAKLESDKIVSFTLSADNNFQQVTFKMTMLATSQITAH
    gas57M28_10218  (1447) KYTVELLTYDTNAAKLESDKIVSFTLSADNNFQQVTFKMTMLATSQITAH
    gas57M28_10266  (1447) KYTVELLTYDTNAAKLESDKIVSFTLSADNNFQQVTFKMTMLATSQITAH
    gas57M28_10299  (1447) KYTVELLTYDTNAAKLESDKIVSFTLSADNNFQQVTFKMTMLATSQITAH
    gas57M28_30176  (1447) KYTVELLTYDTNAAKLESDKIVSFTLSADNNFQQVTFKMTMLATSQITAH
    gas57M28_30574  (1447) KYTVELLTYDTNAAKLESDKIVSFTLSADNNFQQVTFKMTMLATSQITAH
    gas57M6,9_21802 (1450) KYTVELLTYDTNAAKLESDKIVSFTLSADNNFQQITFKMTMLATSQITAH
    gas57M75_10012  (1451) KYTVELLTYDTNAAKLESDKIVSFTLSADNNFQQVTFKMTMLATSQITAH
    gas57M75_20671  (1451) KYTVELLTYDTNAAKLESDKIVSFTLSADNNFQQVTFKMTMLATSQITAH
    gas57M75_30603  (1451) KYTVELLTYDTNAAKLESDKIVSFTLSADNNFQQVTFKMTMLATSQITAH
    gas57M75_30207  (1451) KYTVELLTYDTNAAKLESDKIVSFTLSADNNFQQVTFKMTMLATSQITAH
    gas57M22_20641  (1450) KYTVELLTYDTNAAKLESDKIVSFTLSADNNFQQVTFKMTMLATSQITAH
    gas57M22_23465  (1450) KYTVELLTYDTNAAKLESDKIVSFTLSADNNFQQVTFKMTMLATSQITAH
   gas57M3,1_30610  (1450) KYTVELLTYDTNAAKLESDKIVSFTLSADNNFQQVTFKMTMLATSQITAH
   gas57M3,1_40603  (1450) KYTVELLTYDTNAAKLESDKIVSFTLSADNNFQQVTFKMTMLATSQITAH
  gas57M3,28_24214  (1450) KYTVELLTYDTNAAKLESDKIVSFTLSADNNFQQVTFKMTMLATSQITAH
  gas57M3,34_10307  (1450) KYTVELLTYDTNAAKLESDKIVSFTLSADNNFQQVTFKMTMLATSQITAH
    gas57M4_40427   (1450) KYTVELLTYDTNAAKLESDKIVSFTLSADNNFQQVTFKMTMLATSQITAH
    gas57M3_2721    (1450) KYTVELLTYDTNAAKLESDKIVSFTLSADNNFQQVTFKMTMLATSQITAH
    gas57M12_10296  (1449) KYTVELLTYDTNAAKLESDKIVSFTLSADNNFQQVTFKMTMLATSQITAH
    gas57M12_10035  (1449) KYTVELLTYDTNAAKLESDKIVSFTLSADNNFQQVTFKMTMLATSQITAH
    gas57M12_20069  (1449) KYTVELLTYDTNAAKLESDKIVSFTLSADNNFQQVTFKMTMLATSQITAH
    gas57M12_22432  (1449) KYTVELLTYDTNAAKLESDKIVSFTLSADNNFQQVTFKMTMLATSQITAH
    gas57M4_40499   (1449) KYTVELLTYDTNAAKLESDKIVSFTLSADNNFQQVTFKMTMLATSQITAH
   gas57M6,1_21259  (1449) KYTVELLTYDTNAAKLESDKIVSFTLSADNNFQQVTFKMTMLATSQITAH
```

FIG. 10EE

```
                           1501                                              1550
   gas57M1_SF370    (1499) FDHLLPEGSRVSLKTAQDQLIPLEQSLYVPKAYGKTVQEGTYEVVVSLPK
    gas57M1_31075   (1499) FDHLLPEGSRVSLKTAQDQLIPLEQSLYVPKAYGKTVQEGTYEVVVSLPK
    gas57M1_31237   (1499) FDHLLPEGSRVSLKTAQDQLIPLEQSLYVPKAYGKTVQEGTYEVVVSLPK
     gas57M1_3348   (1499) FDHLLPEGSRVSLKTAQDQLIPLEQSLYVPKAYGKTVQEGTYEVVVSLPK
    gas57M2_34585   (1499) FDHLLPEGSRVSLKTAQDQLIPLEQSLYVPKAYGKTVQEGTYEVVVSLPK
  gas57M3,1_21398   (1499) FDHLLPEGSRVSLKTAQGQLIPLEQSLYVPKAYGKTVQEGTYEVVVSLPK
 gas57M44-61_20839  (1499) FDHLLPEGSRVSLKTAQGQLIPLEQSLYVPKAYGKTVQEGTYEVVVSLPK
   gas57M6,31_20022 (1498) FDHLLPEGSRVSLKTAQGQLIPLEQSLYVPKAYGKTVQEGTYEVVVSLPK
     gas57M11_20648 (1497) FDHLLPEGSRVSLKTAQGQLIPLEQSLYVPKAYGKTVQEGTYEVVVSLPK
      gas57M23_2071 (1498) FDHLLPEGSRVSLKTAQGQLIPLEQSLYVPKAYGKTVQEGTYEVVVSLPK
  gas57M18,3_40128  (1499) FDHLLPEGSRVSLKTAQGQLIPLEQSLYVPKAYGKTVQEDTYEVVVSLPK
     gas57M4_10092  (1499) FDHLLPEGSRVSLKTAQGQLIPLEQSLYVPKAYGKTVQEDTYEVVVSLPK
     gas57M4_30968  (1499) FDHLLPEGSRVSLKTAQGQLIPLEQSLYVPKAYGKTVQEDTYEVVVSLPK
  gas57M6,31_22692  (1499) FDHLLPEGSRVSLKTAQGQLIPLEQSLYVPKAYGKTVQEDTYEVVVSLPK
  gas57M68,5_22814  (1498) FDHLLPEGSRVSLKTAQGQLIPLEQSLYVPKAYGKTVQEGTYEVVVSLPK
     gas57M68_23623 (1499) FDHLLPEGSRVSLKTAQGQLIPLEQSLYVPKAYGKTVQEGTYEVVVSLPK
     gas57M2_10064  (1497) FDHLLPEGSRVSLKTAQGQLIPLEQSLYVPKAYGKTVQEGTYEVVVSLPK
     gas57M2_10065  (1497) FDHLLPEGSRVSLKTAQGQLIPLEQSLYVPKAYGKTVQEGTYEVVVSLPK
     gas57M77_10251 (1497) FDHLLPEGSRVSLKTAQGQLIPLEQSLYVPKAYGKTVQEGTYEVVVSLPK
     gas57M77_10527 (1497) FDHLLPEGSRVSLKTAQGQLIPLEQSLYVPKAYGKTVQEGTYEVVVSLPK
     gas57M77_20696 (1497) FDHLLPEGSRVSLKTAQGQLIPLEQSLYVPKAYGKTVQEGTYEVVVSLPK
     gas57M89_21915 (1499) FDHLLPEGSRVSLKTAQGQLIPLGQSLYVPKAYGKTVQEGTYEVVVSLPK
     gas57M89_23717 (1499) FDHLLPEGSRVSLKTAQGQLIPLGQSLYVPKAYGKTVQEGTYEVVVSLPK
     gas57M94_10134 (1497) FDHLLPEGSRVSLKTAQGQLIPLEQSLYVPKAYGKTVQEGTYEVVVSLPK
     gas57M28_10164 (1497) FDHLLPEGSRVSLKTAQGQLIPLEQSLYVPKAYGKTVQEGTYEVVVSLPK
     gas57M28_10218 (1497) FDHLLPEGSRVSLKTAQGQLIPLEQSLYVPKAYGKTVQEGTYEVVVSLPK
     gas57M28_10266 (1497) FDHLLPEGSRVSLKTAQGQLIPLEQSLYVPKAYGKTVQEGTYEVVVSLPK
     gas57M28_10299 (1497) FDHLLPEGSRVSLKTAQGQLIPLEQSLYVPKAYGKTVQEGTYEVVVSLPK
     gas57M28_30176 (1497) FDHLLPEGSRVSLKTAQGQLIPLEQSLYVPKAYGKTVQEGTYEVVVSLPK
     gas57M28_30574 (1497) FDHLLPEGSRVSLKTAQGQLIPLEQSLYVPKAYGKTVQEGTYEVVVSLPK
   gas57M6,9_21802  (1500) FDHLLPEGSRVSLKTAQGQLIPLEQSLYVPKAYGKTVQEGTYEVVVSLPK
     gas57M75_10012 (1501) FDHLLPEGSRVSLKTAQGQLIPLEQSLYVPKAYGKTVQEGTYEVVVSLPK
     gas57M75_20671 (1501) FDHLLPEGSRVSLKTAQGQLIPLEQSLYVPKAYGKTVQEGTYEVVVSLPK
     gas57M75_30603 (1501) FDHLLPEGSRVSLKTAQGQLIPLEQSLYVPKAYGKTVQEGTYEVVVSLPK
     gas57M75_30207 (1501) FDHLLPEGSRVSLKTAQGQLIPLEQSLYVPKAYGKTVQEGTYEVVVSLPK
     gas57M22_20641 (1500) FDHLLPEGSRVSLKTAQGQLIPLEQSLYVPKAYGKTVQEGTYEVVVSLPK
     gas57M22_23465 (1500) FDHLLPEGSRVSLKTAQGQLIPLEQSLYVPKAYGKTVQEGTYEVVVSLPK
  gas57M3,1_30610  (1500) FDHLLPEGSRVSLKTAQGQLIPLEQSLYVPKAYGKTVQEGTYEVVVSLPK
  gas57M3,1_40603  (1500) FDHLLPEGSRVSLKTAQGQLIPLEQSLYVPKAYGKTVQEGTYEVVVSLPK
  gas57M3,28_24214 (1500) FDHLLPEGSRVSLKTAQGQLIPLEQSLYVPKAYGKTVQEGTYEVVVSLPK
  gas57M3,34_10307 (1500) FDHLLPEGSRVSLKTAQGQLIPLEQSLYVPKAYGKTVQEGTYEVVVSLPK
     gas57M4_40427  (1500) FDHLLPEGSRVSLKTAQGQLIPLEQSLYVPKAYGKTVQEGTYEVVVSLPK
      gas57M3_2721  (1500) FDHLLPEGSRVSLKTAQGQLIPLEQSLYVPKAYGKTVQEGTYEVVVSLPK
     gas57M12_10296 (1499) FDHLLPEGSRVSLKTAQGQLIPLEQSLYVPKAYGKTVQEGTYEVVVSLPK
     gas57M12_10035 (1499) FDHLLPEGSRVSLKTAQGQLIPLEQSLYVPKAYGKTVQEGTYEVVVSLPK
     gas57M12_20069 (1499) FDHLLPEGSRVSLKTAQGQLIPLEQSLYVPKAYGKTVQEGTYEVVVSLPK
     gas57M12_22432 (1499) FDHLLPEGSRVSLKTAQGQLIPLEQSLYVPKAYGKTVQEGTYEVVVSLPK
     gas57M4_40499  (1499) FDHLLPEGSRVSLKTAQGQLIPLEQSLYVPKAYGKTVQEGTYEVVVSLPK
  gas57M6,1_21259  (1499) FDHLLPEGSRVSLKTAQGQLIPLEQSLYVPKAYGKTVQEGTYEVVVSLPK
```

FIG. 10FF

```
                              1551                                              1600
   gas57M1_SF370    (1549) GYRIEGNTKVNTLPNEVHELSLRLVKVGDASDSTGDHKVMSKNNSQALTA
   gas57M1_31075    (1549) GYRIEGNTKVNTLPNEVHELSLRLVKVGDASDSTGDHKVMSKNNSQALTA
   gas57M1_31237    (1549) GYRIEGNTKVNTLPNEVHELSLRLVKVGDASDSTGDHKVMSKNNSQALTA
    gas57M1_3348    (1549) GYRIEGNTKVNTLPNEVHELSLRLVKVGDASDSTGDHKVMSKNNSQALTA
    gas57M2_34585   (1549) GYRIEGNTKVNTLPNEVHELSLRLVKVGDASDSTGDHKVMSKNNSQALTA
  gas57M3,1_21398   (1549) GYRIEGNTKVNTLPNEVHELSLRLVKVGDASDSTGDHKVMSKNNSQALTA
 gas57M44-61_20839  (1549) GYRIEGNTKVNALPNEVHELSLRLVKVGDASDSTGDHKVMSKNNSQALTA
  gas57M6,31_20022  (1548) GYRIEGNTKVNALPNEVHELSLRLVKVGDASDSTGDHKVMSKNNSQALTA
   gas57M11_20648   (1547) GYRIEGNTKVNTLPNEVIIELSLRLVKVGDASDSTGDHKVMSKNNSQALTA
    gas57M23_2071   (1548) GYRIEGNTKVNTLPNEVHELSLRLVKVGDASDSTGDHKVMSKNNSQALTA
  gas57M18,3_40128  (1549) GYRIEGNTKVNTLPNEVHELSLRLVKVGDASDSTGDHKVMSKNNSQALTA
    gas57M4_10092   (1549) GYRIEGNTKVNALPNEVHELSLRLVKVGDASDSTGDHKVMSKNNSQALTV
    gas57M4_30968   (1549) GYRIEGNTKVNALPNEVHELSLRLVKVGDASDSTGDHKVMSKNNSQALTV
  gas57M6,31_22692  (1549) GYRIEGNTKVNALPNEVHELSLRLVKVGDASDSTGDHKVMSKNNSQALTV
  gas57M68,5_22814  (1548) GYRIEGNTKVNALPNEVHELSLRLVKVGDASDSTGDHKVMSKNNSQALTA
    gas57M68_23623  (1549) GYRIEGNTKVNALPNEVHELSLRLVKVGDASDSTGDHKVMSKNNSQALTA
    gas57M2_10064   (1547) GYRIEGNTKVNALPNEVHELSLRLVKVGDASDSTGDHKVMSKNNSQALTA
    gas57M2_10065   (1547) GYRIEGNTKVNALPNEVHELSLRLVKVGDASDSTGDHKVMSKNNSQALTA
    gas57M77_10251  (1547) GYRIEGNTKVNALPNEVHELSLRLVKVGDASDLTGDHKVMSKNNSQALTA
    gas57M77_10527  (1547) GYRIEGNTKVNALPNEVHELSLRLVKVGDASDLTGDHKVMSKNNSQALTA
    gas57M77_20696  (1547) GYRIEGNTKVNALPNEVHELSLRLVKVGDASDLTGDHKVMSKNNSQALTA
    gas57M89_21915  (1549) GYRIEGNTKVNALPNEVHELSLRLVKVGDASDSTGDHKVMSKNNSQALTA
    gas57M89_23717  (1549) GYRIEGNTKVNALPNEVHELSLRLVKVGDASDSTGDHKVMSKNNSQALTA
    gas57M94_10134  (1547) GYRIEGNTKVNTLPNEVHELSLRLVKVGDASDSTGDHKVMSKNNSQALTA
    gas57M28_10164  (1547) GYRIEGNTKVNTLPNEVHELSLRLVKVGDASDSTGDHKVMSKNNSQALTA
    gas57M28_10218  (1547) GYRIEGNTKVNTLPNEVHELSLRLVKVGDASDSTGDHKVMSKNNSQALTA
    gas57M28_10266  (1547) GYRIEGNTKVNTLPNEVHELSLRLVKVGDASDSTGDHKVMSKNNSQALTA
    gas57M28_10299  (1547) GYRIEGNTKVNTLPNEVHELSLRLVKVGDASDSTGDHKVMSKNNSQALTA
    gas57M28_30176  (1547) GYRIEGNTKVNTLPNEVHELSLRLVKVGDASDSTGDHKVMSKNNSQALTA
    gas57M28_30574  (1547) GYRIEGNTKVNTLPNEVHELSLRLVKVGDASDSTGDHKVMSKNNSQALTA
   gas57M6,9_21802  (1550) GYRIEGNTKVNTLPNEVHELSLRLVKVGDASDSTGDHKVMSKNNSQALTA
    gas57M75_10012  (1551) GYRIEGNTKVNTLPNEVHELSLRLVKVGDASDSTGDHKVMSKNNSQALTA
    gas57M75_20671  (1551) GYRIEGNTKVNTLPNEVIIELSLRLVKVGDASDSTGDHKVMSKNNSQALTA
    gas57M75_30603  (1551) GYRIEGNTKVNTLPNEVHELSLRLVKVGDASDSTGDHKVMSKNNSQALTA
    gas57M75_30207  (1551) GYRIEGNTKVNTLPNEVHELSLRLVKVGDASDSTGDHKVMSKNNSQALTA
    gas57M22_20641  (1550) GYRIEGNTKVNTLPNEVHELSLRLVKVGDASDSTGDHKVMSKNNSQALTA
    gas57M22_23465  (1550) GYRIEGNTKVNTLPNEVHELSLRLVKVGDASDSTGDHKVMSKNNSQALTA
  gas57M3,1_30610   (1550) GYRIEGDTKVNALPNEVHELSLRLVKVGDASDSTGDHKVMSKNNSQALTA
  gas57M3,1_40603   (1550) GYRIEGDTKVNALPNEVHELSLRLVKVGDASDSTGDHKVMSKNNSQALTA
  gas57M3,28_24214  (1550) GYRIEGDTKVNALPNEVHELSLRLVKVGDASDSTGDHKVMSKNNSQALTA
  gas57M3,34_10307  (1550) GYRIEGDTKVNALPNEVHELSLRLVKVGDASDSTGDHKVMSKNNSQALTA
    gas57M4_40427   (1550) GYRIEGNTKVNALPNEVHELSLRLVKVGDASDSTGDHKVMSKNNSQALTA
    gas57M3_2721    (1550) GYRIEGDTKVNALPNEVHELSLRLVKVGDASDSTGDHKVMSKNNSQALTA
    gas57M12_10296  (1549) GYRIEGNTKVNTLPNEVHELSLRLVKVGDASDSTGDHKVMSKNNSQALTA
    gas57M12_10035  (1549) GYRIEGNTKVNTLPNEVHELSLRLVKVGDASDSTGDHKVMSKNNSQALTA
    gas57M12_20069  (1549) GYRIEGNTKVNTLPNEVHELSLRLVKVGDASDSTGDHKVMSKNNSQALTA
    gas57M12_22432  (1549) GYRIEGNTKVNTLPNEVHELSLRLVKVGDASDSTGDHKVMSKNNSQALTA
    gas57M4_40499   (1549) GYRIEGNTKVNTLPNEVHELSLRLVKVGDASDSTGDHKVMSKNNSQALTA
  gas57M6,1_21259   (1549) GYRIEGNTKVNTLPNEVHELSLRLVKVGDASDSTGDHKVMSKNNSQALTA
```

FIG. 10GG

```
                              1601                                              1650
   gas57M1_SF370     (1599)  SATPTKSTTSATAKALPSTGEKMGLKLRIVGLVLLGLTCVFSRKKSTKD-
   gas57M1_31075    (1599)  SATPTKSTTSATAKALPSTGEKMGLKLRIVGLVLLGLTCVFSRKKSTKD-
   gas57M1_31237    (1599)  SATPTKSTTSATAKALPSTGEKMGLKLRIVGLVLLGLTCVFSRKKSTKD-
    gas57M1_3348    (1599)  SATPTKSTTSATAKALPSTGEKMGLKLRIVGLVLLGLTCVFSRKKSTKD-
   gas57M2_34585    (1599)  SATPTKSTTSATAKALPSTGEKMGLKLRIVGLVLLGLTCVFSRKKSTKD-
  gas57M3,1_21398   (1599)  SATPTKTTTSATAKALPSTGEKMGLKLRIVGLVLLGLTCVFSRKKSTKD-
 gas57M44-61_20839  (1599)  SATPTKTTTSATAKALPSAGEKMGLKLRIVGLVLLGLTCVFSRKKSTKD-
   gas57M6,31_20022 (1598)  SARPTKTTTSATAKALPSAGEKMGLKLRIVGLVLLGLTCVFSRKKSTKE-
    gas57M11_20648  (1597)  SATPTKTTTSATAKALPSAGEKMGLKLRIVGLVLLGLTCVFSRKKSTKD-
    gas57M23_2071   (1598)  SATPTKTTTSATAKALPSAGEKMGLKLRIVGLVLLGLTCVFSRKKSTKD-
   gas57M18,3_40128 (1599)  SATPTKTTTSATAKALPSTGEKMGLKLRIVGLVLLGLTCVFSRKKSTKD-
    gas57M4_10092   (1599)  SATPTKTTTSATAKALPSAGEKMGLKLRIVGLVLLGLTCVFSRKKSTKD-
    gas57M4_30968   (1599)  SATPTKTTTSATAKALPSAGEKMGLKLRIVGLVLLGLTCVFSRKKSTKD-
   gas57M6,31_22692 (1599)  SATPTKTTTSATAKALPSAGEKMGLKLRIVGLVLLGLTCVFSRKKSTKD-
   gas57M68,5_22814 (1598)  SATPTKTTTSATAKALPSTGEKMGLKLRIVGLVLLGLTCVFSRKKSTKD-
    gas57M68_23623  (1599)  SATPTKTTTSATAKALPSTGEKMGLKLRIVGLVLLGLTCVFSRKKSTKD-
    gas57M2_10064   (1597)  SATPTKTTTSATAKALPSTGEKMGLKLRIVGLVLLGLTCVFSRKKSTKD-
    gas57M2_10065   (1597)  SATPTKTTTSATAKALPSTGEKMGLKLRIVGLVLLGLTCVFSRKKSTKD-
    gas57M77_10251  (1597)  SATPTKTTTSATAKALPSAGEKMGLKLRIVGLVLLGLTCVFSRKKSTKD-
    gas57M77_10527  (1597)  SATPTKTTTSATAKALPSAGEKMGLKLRIVGLVLLGLTCVFSRKKSTKD-
    gas57M77_20696  (1597)  SATPTKTTTSATAKALPSAGEKMGLKLRIVGLVLLGLTCVFSRKKSTKD-
    gas57M89_21915  (1599)  SATPTKTTTSATAKALPSAGEKMGLKLRIVGLVLLGLTCVFSRKKSTKD-
    gas57M89_23717  (1599)  SATPTKTTTSATAKALPSAGEKMGLKLRIVGLVLLGLTCVFSRKKSTKD-
    gas57M94_10134  (1597)  SATPTKTTTSATAKALPSAGEKMGLKLRIVGLVLLGLTCVFSRKKSTKD-
    gas57M28_10164  (1597)  SATPTKTTTSATAKALPSAGEKMGLKLRIVGLVLLGLTCVFSRKKSTKD-
    gas57M28_10218  (1597)  SATPTKTTTSATAKALPSAGEKMGLKLRIVGLVLLGLTCVFSRKKSTKD-
    gas57M28_10266  (1597)  SATPTKTTTSATAKALPSAGEKMGLKLRIVGLVLLGLTCVFSRKKSTKD-
    gas57M28_10299  (1597)  SATPTKTTTSATAKALPSAGEKMGLKLRIVGLVLLGLTCVFSRKKSTKD-
    gas57M28_30176  (1597)  FATPTKTTTSATAKALPSAGEKMGLKLRIVGLVLLGLTCVFSRKKSTKD-
    gas57M28_30574  (1597)  SATPTKTTTSATAKALPSAGEKMGLKLRIVGLVLLGLTCVFSRKKSTKD-
   gas57M6,9_21802  (1600)  SATPTKTTTSATAKALPSAGEKMGLKLRIVGLVLLGLTCVFSRKKSTKD-
    gas57M75_10012  (1601)  SATPTKTTTSATAKALPSTGEKMGLKLRIVGLVLLGLTCVFSRKKSTKD-
    gas57M75_20671  (1601)  SATPTKTTTSATAKALPSTGEKMGLKLRIVGLVLLGLTCVFSRKKSTKD-
    gas57M75_30603  (1601)  SATPTKTTTSATAKALPSTGEKMGLKLRIVGLVLLGLTCVFSRKKSTKD-
    gas57M75_30207  (1601)  SATPTKTTTSATAKALPSTGEKMGLKLRIVGLVLLGLTCVFSRKKSTKE-
    gas57M22_20641  (1600)  SATPTKTTTSATAKALPSTGEKMGLKLRIVGLVLLGLTCVFSRKKSTKD-
    gas57M22_23465  (1600)  SATPTKTTTSATAKALPSTGEKMGLKLRIVGLVLLGLTCVFSRKKSTKD-
   gas57M3,1_30610  (1600)  SATPTKTTTSATAKALPSAGEKMGLKLRIVGLVLLGLTCVFSRKKSTKD-
   gas57M3,1_40603  (1600)  SATPTKTTTSATAKALPSAGEKMGLKLRIVGLVLLGLTCVFSRKKSTKD-
  gas57M3,28_24214  (1600)  SATPTKTTTSATAKALPSAGEKMGLKLRIVGLVLLGLTCVFSRKKSTKD-
  gas57M3,34_10307  (1600)  SATPTKTTTSATAKALPSAGEKMGLKLRIVGLVLLGLTCVFSRKKSTKD-
    gas57M4_40427   (1600)  SATPTKTTTSATAKALPSAGEKMGLKLRIVGLVLLGLTCVFSRKKSTKD-
     gas57M3_2721   (1600)  SATPTKTTTSATAKALPSAGEKMGLKLRIVGLVLLGLTCVFSRKKSTKD-
    gas57M12_10296  (1599)  SATPTKTTTSATAKALPSAGEKMGLKLRIVGLVLLGLTCVFSRKKSTKD-
    gas57M12_10035  (1599)  SATPTKTTTSATAKALPSAGEKMGLKLRIVGLVLLGLTCVFSRKKSTKD-
    gas57M12_20069  (1599)  SATPTKTTTSATAKALPSAGEKMGLKLRIVGLVLLGLTCVFSRKKSTKD-
    gas57M12_22432  (1599)  SATPTKTTTSATAKALPSAGEKMGLKLRIVGLVLLGLTCVFSRKKSTKD-
    gas57M4_40499   (1599)  SATPTKTTTSATAKALPSAGEKMGLKLRIVGLVLLGLTCVFSRKKSTKD-
   gas57M6,1_21259  (1599)  SATPTKTTTSATAKALPSAGEKMGLKLRIVGLVLLGLTCVFSRKKSTKD-
```

FIG. 11

```
CxCL4        ----MSSAAGFCASRPGLLFLGLLLLP-LVVAFAS----------AEAEED-------GD  38
CXCL7        MSLRLDTTPSCNSARPLHALQVLLLLSLLLTALASSTKGQTKRNLAKGKEESLDSDLYAE  60
CXCL1        ----MARAALSAAPSNPRLLRVALLLLLLVAAGRR----------AAGASVA------TE  40
CXCL2        ----MARATLSAAPSNPRLLRVALLLLLLVAASRR----------AAGAPLA------TE  40
CXCL3        ----MAHATLSAAPSNPRLLRVALLLLLLVAASRR----------AAGASVV------TE  40
CXCL6        --MSLPSSRAARVPGPSGSLCALLALLLLLTPPGP----------LASAGPVS---AVLTE  46
CXCL8        ------MTSKLAVALLAAFLISAALCEGAVLPRSAK-------------------------E  31
CXCL12alpha  --------------MNAKVVVVLVLVLTALCLSDGK--------------PVS------LS  27
CXCL12gamma  --------------MNAKVVVVLVLVLTALCLSDGK--------------PVS------LS  27
CXCL12beta   --------------MNAKVVVVLVLVLTALCLSDGK--------------PVS------LS  27
CXCL9        -------------MKKSGVLFLLGIILLVLIGVQGTP---------------------VVRK  28
CXCL10       -----------MNQTAILICC-LIFLTLSGIQGVP-----------------------LSRT  27
CXCL11       ------------MSVKGMAIALAVILCATV-VQGFP---------------------MFKR  27
                                 .  :

CxCL4        LQCLCVKTTSQ-VRPRHITSLEVIKAGPHCPTAQLIATLKN-GRKICLDLQAPLYKKIIK  96
CXCL7        LRCMCIKTTSG-IHPKNIQSLEVIGKGTHCNQVEVIATLKD-GRKICLDPDAPRIKKIVQ 118
CXCL1        LRCQCLQTLQG-IHPKNIQSVNVKSPGPHCAQTEVIATLKN-GRKACLNPASPIVKKIIE  98
CXCL2        LRCQCLQTLQG-IHLKNIQSVNVKSPGPHCAQTEVIATLKN-GQKACLNPASPMVKKIIE  98
CXCL3        LRCQCLQTLQG-IHLKNIQSVNVRSPGPHCAQTEVIATLKN-GKKACLNPASPMVQKTIE  98
CXCL6        LRCTCLRVTLR-VNPKTIGKLQVFPAGPQCSKVEVVASLKN-GKQVCLDPEAPFLKKVIQ 104
CXCL8        LRCQCIKTYSKPFHPKFIKELRVIESGPHCANTEIIVKLSD-GRELCLDPKENWVQRVVE  90
CXCL12alpha  YRCPCRFFESH-VARANVKHLKILN-TPNCALQIVARLKNN-NRQVCIDPKLKWIQEYLE  84
CXCL12gamma  YRCPCRFFESH-VARANVKHLKILN-TPNCALQIVARLKNN-NRQVCIDPKLKWIQEYLE  84
CXCL12beta   YRCPCRFFESH-VARANVKHLKILN-TPNCALQIVARLKNN-NRQVCIDPKLKWIQEYLE  84
CXCL9        GRCSCISTNQGTIHLQSLKDLKQFAPSPSCEKIEIIATLKN-GVQTCLNPDSADVKELIK  87
CXCL10       VRCTCISISNQPVNPRSLEKLEIIPASQFCPRVEIIATMKKKGEKRCLNPESKAIKNLLK  87
CXCL11       GRCLCIGPGVKAVKVADIEKASIMYPSNNCDKIEVIITLKENKGQRCLNPKSKQARLIIK  87
                :* *             .   :          *    :    .. : *::      : ::

CxCL4        KLLESCXCL---------------------------- 105
CXCL7        KKLAGDESAD---------------------------- 128
CXCL1        KMLNSDKSN----------------------------- 107
CXCL2        KMLKNGKSN----------------------------- 107
CXCL3        KILNKGSTN----------------------------- 107
CXCL6        KILDSGNKKN---------------------------- 114
CXCL8        KFLKRAENS------------------------------ 99
CXCL12alpha  KALNK---------------------------------- 89
CXCL12gamma  KALNKGRREEKVGKKEKIGKKKRQKKRKAAQKRKN--- 119
CXCL12beta   KALNKRFKM------------------------------ 93
CXCL9        KWEKQVSQKKKQKNGKKHQKKKVLKVRKSQRSRQKKTT 125
CXCL10       ----AVSKER----------------SKRSP------- 98
CXCL11       ----KVERKNF---------------------------- 94
```

GAS57 MUTANT ANTIGENS AND GAS57 ANTIBODIES

This application is a national phase application of PCT/IB2008/003078 filed on Sep. 12, 2008 and published in English as WO 2009/034473 on Mar. 19, 2009. PCT/IB2008/003078 claims the benefit of Ser. No. 60/971,637 filed on Sep. 12, 2007.

This application incorporates by reference the contents of a 756 kb text file created on Mar. 3, 2010 and named "PAT052285_sequencelisting.txt," which is the sequence listing for this application.

FIELD OF THE INVENTION

This invention is in the fields of immunology and vaccinology. In particular, it relates to antigens derived from *Streptococcus pyogenes* and their use in immunization.

BACKGROUND OF THE INVENTION

*S. pyogenes* (Group A *Streptococcus*; GAS) antigen GAS57, expressed as recombinant protein and purified from *E. coli*, induces protective activity against a lethal challenge with *S. pyogenes* in mice. However, GAS57 is a protease which cleaves and inactivates human chemokines such as interleukin-8 (IL-8) (Edwards et al., *J. Infectious Diseases* 192, 783-90, 2005; Hidalgo-Grass et al., *EMBO J.* 25, 4628-37, 2006). This property of GAS57 may hamper its use in a vaccine composition, due to possible side effects. Thus, there is a need in the art for GAS57 antigens which are unable to cleave human chemokines but which still maintain the ability to induce protection against *S. pyogenes*. There is also a need in the art for antibodies which specifically bind to GAS57 antigens and which impair the ability of GAS57 to cleave IL-8 and other substrates.

BRIEF DESCRIPTION OF THE FIGURES

FIG. 2. BLAST alignment of wild-type GAS57 (query, SEQ ID NO:1) vs a C5a peptidase serine protease (Sbjct, SEQ ID NO:9).

FIGS. 5A-B. Photomicrographs of SDS-polyacrylamide gels demonstrating that GAS57 single mutants D151A and S617A and the double mutant D151A+S617A have lost GAS57 proteolytic activity.

FIG. 9A, 8 hour incubation, 0.1 µg/ml of GAS57. FIG. 9B, 24 hour incubation, 0.05 µg/ml of GAS57.

FIG. 10A-GG. Alignments of GAS57 antigens from different strains/M types. The catalytic triad (D, H, S) is in bold black characters. FIG. 10A, amino acids 1-50 (amino acid numbers at the top of each of FIGS. 10A-GG refers to the amino acid sequence of gas57M1_SF370, SEQ ID NO:1); FIG. 10B, amino acids 51-100; FIG. 10C, amino acids 101-150; FIG. 10D, amino acids 151-200; FIG. 10E, amino acids 201-250; FIG. 10F, amino acids 251-300; FIG. 10G, amino acids 301-350; FIG. 1H, amino acids 351-400, FIG. 10I, amino acids 401-450; FIG. 10J, amino acids 451-500; FIG. 10K, amino acids 501-550; FIG. 10L, amino acids 551-600; FIG. 10M, amino acids 601-650; FIG. 10N, amino acids 651-700; FIG. 10O, amino acids 701-750; FIG. 10P, amino acids 751-800; FIG. 10Q, amino acids 801-850; FIG. 10R, amino acids 851-900; FIG. 10S, amino acids 901-950; FIG. 10T, amino acids 951-1000; FIG. 10U, amino acids 1001-1050; FIG. 10V, amino acids 1051-1100; FIG. 10W, amino acids 1101-1150; FIG. 10X, amino acids 1151-1200; FIG. 10Y, amino acids 1201-1250; FIG. 10Z, amino acids 1251-1300; FIG. 10AA, amino acids 1301-1350; FIG. 10BB, amino acids 1351-1400; FIG. 10CC, amino acids 1401-1450; FIG. 10DD, amino acids 1451-1500; FIG. 10EE, amino acids 1501-1550; FIG. 10FF, amino acids 1551-1600; FIG. 10GG, amino acids 1601-1650. gas57M1_SF370, SEQ ID NO:1; gas57M1_31075, SEQ ID NO:10; gas57M1_31237, SEQ ID NO:11; gas57M1_3348, SEQ ID NO:12; gas57M2_34585, SEQ ID NO:13; gas57M3,1_21398, SEQ ID NO:14; gas57M44-61_20839, SEQ ID NO:15; gas57M6,31_20022, SEQ ID NO:16; gas57M11_20648, SEQ ID NO:17; gas57M23_2071, SEQ ID NO:18; gas57M18,3_40128, SEQ ID NO:19; gas47M4_10092, SEQ ID NO:20; gas57M4_30968, SEQ ID NO:21; gas57M6,31_22692, SEQ ID NO:22; gas57M68,5_22814, SEQ ID NO:23; gas57M68_23623, SEQ ID NO:24; gas57M2_10064, SEQ ID NO:25; gas57M2_10065, SEQ ID NO:26; gas57M77_10251, SEQ ID NO:27; gas57M77_10527, SEQ ID NO:28; gas57M77_20696, SEQ ID NO:29; gas57M89_21915, SEQ ID NO:30; gas57M89_23717, SEQ ID NO:31; gas57M94_10134, SEQ ID NO:32; gas57M28_10164, SEQ ID NO:33; gas57M28_10218, SEQ ID NO:34; gas57M29_10266, SEQ ID NO:35; gas57M28_10299, SEQ ID NO:36; gas57M28_30176, SEQ ID NO:37; gas57M28_30574, SEQ ID NO:38; gas57M6,9_21802, SEQ ID NO:39; gas57M75_20671, SEQ ID NO:40; gas57M75_30603, SEQ ID NO:41; gas57M75_30207, SEQ ID NO:42; gas57M22_20641, SEQ ID NO:43; gas57M22_23465, SEQ ID NO:44; gas57M3,1_30610, SEQ ID NO:45; gas57M3,1_40603, SEQ ID NO:46; gas57M3,28_24214, SEQ ID NO:47; gas57M3,34_10307, SEQ ID NO:48; gas57M4_40427, SEQ ID NO:49; gas57M3_2721, SEQ ID NO:50; gas57M12_10296, SEQ ID NO:51; gas57M12_10035, SEQ ID NO:52; gas57M12_20069, SEQ ID NO:53; gas57M12_22432, SEQ ID NO:54; gas57M4_40499, SEQ ID NO:55; and gas57M6,1_21259, SEQ ID NO:56; gas57M75_20671, SEQ ID NO:80.

FIG. 11. Alignment of human chemokines. GAS57 cleaves CXCL8 (IL-8) (SEQ ID NO:81) between the two bolded and underlined amino acids. CXCL4, SEQ ID NO:57; CXCL7/NAP-2, SEQ ID NO:58; CXCL1/GROα, SEQ ID NO:59; CXCL2/GROβ, SEQ ID NO:60; CXCL3/GROγ, SEQ ID NO:61; CXCL6/GCP-2, SEQ ID NO:62; CXCL12/SDF-1α, SEQ ID NO:63; CXCL12/SDF-1γ, SEQ ID NO:64; CXCL12/SDF-1β, SEQ ID NO:65; CXCL9/MIG, SEQ ID NO:66; CXCL10/IP10, SEQ ID NO:67; and CXCL11, SEQ ID NO:68.

DETAILED DESCRIPTION OF THE INVENTION

Figure 1:
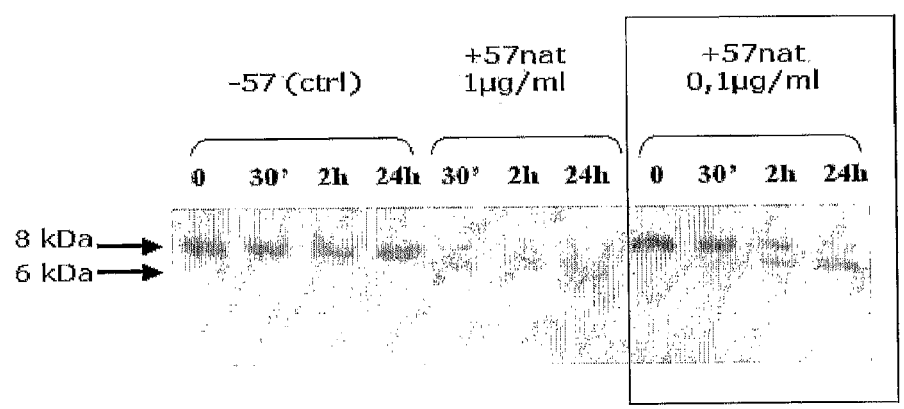
FIG. 1. Photomicrograph of an SDS-polyacrylamide gel demonstrating cleavage of IL-8 by wild-type GAS57.

The invention provides mutants of Spy0416 or GAS57 (referred to herein as "GAS57 mutant antigens," "GAS57 mutants," "mutant GAS57 antigens") which are unable to cleave human chemokines like IL-8 but which still maintain the ability to induce protection against S. pyogenes. GAS57 mutants of the invention are useful in vaccine compositions, to induce protection against S. pyogenes. The invention also provides antibodies which specifically bind to wild-type GAS57 and which inhibit the ability of GAS57 to cleave IL-8 and similar substrates. It is envisaged that the antibodies will be useful as therapeutics for the prevention and/or treatment of S. pyogenes infections.

Mutant GAS57 Antigens

"GAS57" is also referred to as 'Spy0416' (M1), 'SpyM3_0298' (M3), 'SpyM18_0464' (M18) and 'prtS.' GAS57 has also been identified as a putative cell envelope proteinase. See WO 02/34771 and US 2006/0258849. There are 49 GAS57 sequences from 17 different M types (1, 2, 3, 4, 6, 11, 12, 18, 22, 23, 28, 44/61, 68, 75, 77, 89, 94); according to the Centers for Disease Control, the 17 different M types account for over 95% of pharyngitis cases and about 68% of the invasive GAS isolates in the United States. The amino acid sequences of wild-type GAS57 antigens are set forth in the sequence listing as SEQ ID NOS:1, 10-56, and 80. Wild-type GAS57 contains two non-covalently associated peptides (see Example 5 and FIG. 7).

Mutant GAS57 antigens according to the invention have a proteolytic activity against interleukin 8 (IL-8) which is reduced by at least 50% (e.g., 50, 55, 60, 65, 70, 75, 80, 85, 90, 95, 96, 97, 98, 99, or 100%) relative to wild-type GAS57 as detected by either SDS-PAGE or ELISA (see Examples 2 and 3), but are immunogenic, e.g., they confer protection against GAS lethal challenge in a mouse model (Example 4). Preferably, a mutant GAS57 of the invention also does not cleave other human cytokines, such as CXCL1/GROα (e.g., SEQ ID NO:59), CXCL2/GROβ (e.g., SEQ ID NO:60), CXCL3/GROγ (e.g., SEQ ID NO:61), CXCL4 (e.g., SEQ ID NO:57), CXCL12/SDF-1α (e.g., SEQ ID NO:63), CXCL12/SDF-1β (e.g., SEQ ID NO:65), CXCL12/SDF-1γ (e.g., SEQ ID NO:64), CXCL5/ENA78 (e.g, SEQ ID NO:82), CXCL6/GCP-2 (e.g., SEQ ID NO:62), CXCL7/NAP-2 (e.g., SEQ ID NO:58), CXCL9/MIG (e.g., SEQ ID NO:66), CXCL10/IP10 (e.g., SEQ ID NO:67), CXCL11 (e.g., SEQ ID NO:68), CXCL13 (e.g., SEQ ID NO:83), CXCL14 (e.g., SEQ ID NO:84), and CXCL16 (e.g., SEQ ID NO:85). Unexpectedly, GAS57 mutants of the invention are single polypeptides, in contrast to wild-type GAS57, which undergoes post-translational processing (maturation) to form two non-covalently associated peptides (Examples 5 and 6). The ability to obtain such antigens in the form of a single peptide facilitates the production of the recombinant protein for vaccine purposes.

GAS57 mutants of the invention include those with at an amino acid alteration (i.e., a substitution, deletion, or insertion) at one or more of amino acids D151, H279, or S617, numbered according to the wild-type GAS57 sequence shown in SEQ ID NO:1 (see FIG. 10).

GAS57 mutants of the invention include single, double, or triple amino acid alterations ("single mutants," "double mutants," "triple mutants") at positions D151, H279, and/or S617. Thus, GAS57 mutants can comprise the following:
  i. D151A (SEQ ID NO:2), D151R, 151N, D151C, D151Q, D151E, D151G, D151H, D151I, D151L, D151K, D151M, D151F, D151P, D151S, D151T, D151W, D151Y, or D151V;
  ii. H279A, H279R, H279N, H279D, H279C, H279Q, H279E, H279G, H279I, H279L, H279K, H279M, H279F, H279P, H279S, H279T, H279W, H279Y, or H279V;
  iii. S617A (SEQ ID NO:3), S617R, S617N, S617D, S617C, S617Q, S617E, S617G, S617H, S617I, S617L, S617K, S617M, S617F, S617P, S617T, S617W, S617Y, or S617V;
  iv. ΔD151; or ΔH279; or ΔS617; and
  v. combinations thereof, such as D151A+S617A (SEQ ID NO:4).

GAS57 mutant antigens of the invention also include fusion polypeptides which comprise a GAS57 mutant antigen as disclosed above and another GAS antigen. GAS antigens are disclosed, e.g., in WO 02/34771 and include, but are not limited to, GAS25 (Spy0167; gi13621460) GAS39 (Spy0266; gi13621542), GAS40 (Spy0269; gi13621545), GAS42 (Spy0287; gi13621559), GAS45 (M5005_Spy0249; gi71910063), GAS58 (Spy0430; gi13621663), GAS84 (SPy1274; 13622398), GAS95 (SPy1733; 13622787), GAS117 (Spy0448; gi13621679), GAS130 (Spy0591; gi13621794), GAS137 (Spy0652; gi13621842), GAS159 (Spy1105; gi13622244), GAS193 (Spy2025; gi3623029), GAS202 (Spy1309; gi13622431), GAS217 (Spy0925, gi1362208), GAS236 (Spy1126; gi13622264), GAS253 (Spy1524; gi13622611), GAS277 (Spy1939; gi13622962), GAS294 (Spy1173; gi13622306), GAS309 (Spy0124; gi13621426), GAS366 (Spy1525; gi13622612), GAS372 (Spy1625; gi13622698), GAS384 (Spy1874; gi13622908), GAS389 (Spy1981; gi13622996), GAS504 (Spy1751; gi13622806), GAS509 (Spy1618; gi13622692), GAS290 (SPy1959; gi13622978), GAS511 (Spy1743; gi13622798), GAS527 (Spy1204; gi3622332), GAS529 (Spy1280; gi3622403), and GAS533 (Spy1877; gi13622912). GAS antigens also include, GAS68 (Spy0163; gi13621456), GAS84 (Spy1274; gi13622398), GAS88 (Spy1361; gi13622470), GAS89 (Spy1390; gi13622493), GAS98 (Spy1882; gi13622916), GAS99 (Spy1979; gi13622993), GAS102 (Spy2016, gi13623025), GAS146 (Spy0763; gi13621942), GAS195 (Spy2043; gi13623043), GAS561 (Spy1134; gi13622269), GAS179 (Spy1718, gi13622773) and GAS681 (spy1152; gi1362228).

The invention also includes equivalents of GAS57 mutants which are single polypeptides, which do not cleave IL-8 as determined by SDS-PAGE or ELISA, which are immunogenic, and which confer protection against GAS lethal challenge in a mouse model. Such equivalents may include mutant GAS57 antigens with amino acid deletions, insertions, and/or substitutions at positions other than D151, H279, or S617, including deletions of up to about 40 amino acids at the N or C terminus (e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40 amino acids). Such equivalents thus include GAS57 mutants having deletions, insertions, and/or substitutions at positions other than D151, H279, or 5617 in addition to having an amino acid alteration at one or more of amino acids D151, H279 or S617 and S617, as described above.

Nucleic Acid Molecules

The invention includes nucleic acid molecules which encode mutant GAS57 antigens. The invention also includes nucleic acid molecules comprising nucleotide sequences having at least 50% sequence identity to such molecules. Depending on the particular sequence, the degree of sequence identity is preferably greater than 50% (e.g., 60%, 70%, 75%, 80%, 85%, 90%, 91%, 92%, 93%, 94%, 95%, 96%, 97%, 98%, 99% or more). Identity between nucleotide sequences is preferably determined by the Smith-Waterman homology search algorithm as implemented in the MPSRCH program (Oxford Molecular), using an affine gap search with parameters gap open penalty=12 and gap extension penalty=1.

The invention also provides nucleic acid molecules which can hybridize to these molecules. Hybridization reactions can be performed under conditions of different "stringency." Conditions which increase stringency of a hybridization reaction are widely known and published in the art. See, e.g., page 7.52 of Sambrook et al., Molecular Cloning: A Laboratory Manual, 1989. Examples of relevant conditions include (in order of increasing stringency): incubation temperatures of 25° C., 37° C., 50° C., 55° C., and 68° C.; buffer concentrations of 10×SSC, 6×SSC, 1×SSC, and 0.1×SSC (where SSC is 0.15 M NaCl and 15 mM citrate buffer) and their equivalents using other buffer systems; formamide concentrations of 0%, 25%, 50%, and 75%; incubation times from 5 minutes to 24 hours; 1, 2, or more washing steps; wash incubation times of 1, 2, or 15 minutes; and wash solutions of 6×SSC, 1×SSC, 0.1×SSC, or de-ionized water. Hybridization techniques and their optimization are well known in the art. See, e.g., Sambrook, 1989; Ausubel et al., eds., Short Protocols in Molecular Biology, 4th ed., 1999; U.S. Pat. No. 5,707,829; Ausubel et al., eds., Current Protocols in Molecular Biology, Supplement 30, 1987.

In some embodiments, nucleic acid molecules of the invention hybridize to a target under low stringency conditions; in other embodiments, nucleic acid molecules of the invention hybridize under intermediate stringency conditions; in preferred embodiments, nucleic acid molecules of the invention hybridize under high stringency conditions. An example of a low stringency hybridization condition is 50° C. and 10×SSC. An example of an intermediate stringency hybridization condition is 55° C. and 1×SSC. An example of a high stringency hybridization condition is 68° C. and 0.1×SSC.

Production of Mutant GAS57 Antigens

Recombinant Production

The redundancy of the genetic code is well-known. Thus, any nucleic acid molecule (polynucleotide) which encodes wild-type GAS57 protein or a GAS57 mutant protein of the invention can be used to produce that protein recombinantly. Examples of nucleotide sequences which encode wild-type GAS57, GAS57 mutant D151A, GAS57 mutant S617A, and GAS mutant D151A+S617A are provided in SEQ ID NOS:5, 6, 7, and 8, respectively. Nucleic acid molecules encoding wild-type GAS57 also can be isolated from the appropriate S. pyogenes bacterium using standard nucleic acid purification techniques or can be synthesized using an amplification technique, such as the polymerase chain reaction (PCR), or by using an automatic synthesizer. See Caruthers et al., Nucl. Acids Res. Symp. Ser. 215 223, 1980; Horn et al. Nucl. Acids Res. Symp. Ser. 225 232, 1980; Hunkapiller et al., Nature 310, 105-11, 1984; Grantham et al., Nucleic Acids Res. 9, r43-r74, 1981.

cDNA molecules can be made with standard molecular biology techniques, using mRNA as a template. cDNA molecules can thereafter be replicated using molecular biology techniques well known in the art. An amplification technique, such as PCR, can be used to obtain additional copies of polynucleotides of the invention, using either genomic DNA or cDNA as a template.

If desired, polynucleotides can be engineered using methods generally known in the art to alter antigen-encoding sequences for a variety of reasons, including but not limited to, alterations which modify the cloning, processing, and/or expression of the polypeptide or mRNA product. DNA shuffling by random fragmentation and PCR reassembly of gene fragments and synthetic oligonucleotides can be used to engineer the nucleotide sequences. For example, site directed mutagenesis can be used to insert new restriction sites, alter glycosylation patterns, change codon preference, produce splice variants, introduce mutations, and so forth.

Sequence modifications, such as the addition of a purification tag sequence or codon optimization, can be used to facilitate expression. For example, the N-terminal leader sequence may be replaced with a sequence encoding for a tag protein such as polyhistidine ("HIS") or glutathione S-transferase ("GST"). Such tag proteins may be used to facilitate purification, detection, and stability of the expressed protein. Codons preferred by a particular prokaryotic or eukaryotic host can be selected to increase the rate of protein expression or to produce an RNA transcript having desirable properties, such as a half life which is longer than that of a transcript generated from the naturally occurring sequence. These methods are well known in the art and are further described in WO05/032582.

Expression Vectors

A nucleic acid molecule which encodes a mutant GAS57 antigen can be inserted into an expression vector which contains the necessary elements for the transcription and translation of the inserted coding sequence. Methods which are well known to those skilled in the art can be used to construct expression vectors containing coding sequences and appropriate transcriptional and translational control elements. These methods include in vitro recombinant DNA techniques, synthetic techniques, and in vivo genetic recombination.

Host Cells

Host cells for producing mutant GAS57 antigens can be prokaryotic or eukaryotic. *E. coli* is a preferred host cell, but other suitable hosts include *Lactococcus lactis*, *Lactococcus cremoris*, *Bacillus subtilis*, *Vibrio cholerae*, *Salmonella typhi*, *Salmonella typhimurium*, *Neisseria lactamica*, *Neisseria cinerea*, *Mycobacteria* (e.g., *M. tuberculosis*), yeasts, baculovirus, mammalian cells, etc.

A host cell strain can be chosen for its ability to modulate the expression of the inserted sequences or to process the expressed polypeptide in the desired fashion. Such modifications of the polypeptide include, but are not limited to, acetylation, carboxylation, glycosylation, phosphorylation, lipidation, and acylation. Post translational processing which cleaves a "prepro" form of the polypeptide also can be used to facilitate correct insertion, folding and/or function. Different host cells which have specific cellular machinery and characteristic mechanisms for post translational activities are available from the American Type Culture Collection (ATCC; 10801 University Boulevard, Manassas, Va. 20110-2209) and can be chosen to ensure the correct modification and processing of a foreign protein. See WO 01/98340.

Expression constructs can be introduced into host cells using well-established techniques which include, but are not limited to, transferrin-polycation-mediated DNA transfer, transfection with naked or encapsulated nucleic acids, liposome-mediated cellular fusion, intracellular transportation of DNA-coated latex beads, protoplast fusion, viral infection, electroporation, "gene gun" methods, and DEAE- or calcium phosphate-mediated transfection.

Host cells transformed with expression vectors can be cultured under conditions suitable for the expression and recovery of the protein from cell culture. The protein produced by a transformed cell can be secreted or contained intracellularly depending on the nucleotide sequence and/or the expression vector used. Those of skill in the art understand that expression vectors can be designed to contain signal sequences which direct secretion of soluble antigens through a prokaryotic or eukaryotic cell membrane.

Purification

Signal export sequences can be included in a recombinantly produced mutant GAS57 antigen so that the antigen can be purified from cell culture medium using known methods. Alternatively, recombinantly produced mutant GAS57 antigens of the invention can be isolated from engineered host cells and separated from other components in the cell, such as proteins, carbohydrates, or lipids, using methods well-known in the art. Such methods include, but are not limited to, size exclusion chromatography, ammonium sulfate fractionation, ion exchange chromatography, affinity chromatography, and preparative gel electrophoresis. A preparation of purified mutant GAS57 antigens is at least 80% pure; preferably, the preparations are 90%, 95%, or 99% pure. Purity of the preparations can be assessed by any means known in the art, such as SDS-polyacrylamide gel electrophoresis. Where appropriate, mutant GAS57 antigens can be solubilized, for example, with urea.

Chemical Synthesis

Mutant GAS57 antigens can be synthesized, for example, using solid phase techniques. See, e.g., Merrifield, J. Am. Chem. Soc. 85, 2149 54, 1963; Roberge et al., Science 269, 202 04, 1995. Protein synthesis can be performed using manual techniques or by automation. Automated synthesis can be achieved, for example, using Applied Biosystems 431A Peptide Synthesizer (Perkin Elmer). Optionally, fragments of a mutant GAS57 antigen can be separately synthesized and combined using chemical methods to produce a full-length molecule.

GAS57 Antibodies

The invention also provides antibodies which specifically bind to wild-type GAS57 and which substantially reduce or eliminate the ability of GAS57 to cleave IL-8. Some antibodies of the invention also specifically bind to mutant GAS57 as described above. Preferred antibodies also reduce or eliminate the ability of GAS57 to cleave other substrates such as homologs of IL-8 (e.g., CXCL1/GROα, CXCL2/GROβ, CXCL3/GROγ, CXCL4, CXCL12/SDF-1α, CXCL12/SDF-1β, CXCL12/SDF-1γ, CXCL5/ENA 78, CXCL6/GCP-2, CXCL7/NAP-2, CXCL9/MIG, CXCL10/IP10, CXCL11, CXCL13, CXCL14, and CXCL16). An antibody "specifically binds" to wild-type or mutant GAS57 if it provides a detection signal at least 5-, 10-, or 20-fold higher than a detection signal provided with non-GAS57 proteins when used in an immunochemical assay. Preferably, antibodies that specifically bind to wild-type or mutant GAS57 do not detect non-GAS57 proteins in immunochemical assays and can immunoprecipitate wild-type GAS57 from solution. Antibodies according to the invention may reduce the proteolytic activity of GAS57 against interleukin 8 (IL-8) by at least 50% (e.g., 50, 55, 60, 65, 70, 75, 80, 85, 90, 95, 96, 97, 98, 99, or 100%) relative to wild-type GAS57 as detected by either SDS-PAGE or ELISA.

In preferred embodiments, antibodies of the invention block the progression of necrotic lesions in animals immunized with wild-type or mutant GAS57 recombinant antigen and challenged with GAS.

"Antibody" as used herein includes intact immunoglobulin molecules, as well as fragments thereof which specifically bind to wild-type GAS57 and, in some cases, to a GAS57 mutant antigen. These include hybrid (chimeric) antibody molecules (e.g., Winter et al., *Nature* 349, 293-99, 1991; U.S. Pat. No. 4,816,567); $F(ab')_2$ and F(ab) fragments and $F_v$ molecules; non-covalent heterodimers (e.g., Inbar et al., *Proc. Natl. Acad. Sci. U.S.A.* 69, 2659-62, 1972; Ehrlich et al., *Biochem* 19, 4091-96, 1980); single-chain Fv molecules (sFv) (e.g., Huston et al., *Proc. Natl. Acad. Sci. U.S.A.* 85, 5897-83, 1988); dimeric and trimeric antibody fragment constructs; minibodies (e.g., Pack et al., *Biochem* 31, 1579-84, 1992; Cumber et al., *J. Immunology* 149B, 120-26, 1992); humanized antibody molecules (e.g., Riechmann et al., *Nature* 332, 323-27, 1988; Verhoeyan et al., *Science* 239, 1534-36, 1988; and U.K. Patent Publication No. GB 2,276, 169, published 21 Sep. 1994); and any functional fragments obtained from such molecules, as well as antibodies obtained through non-conventional processes such as phage display.

Generation of GAS57 Antibodies

A mutant or wild-type GAS57 antigen can be used to immunize a mammal, such as a mouse, rat, rabbit, guinea pig, monkey, or human, to produce polyclonal antibodies. If desired, a GAS57 antigen can be conjugated to a carrier protein, such as bovine serum albumin, thyroglobulin, and keyhole limpet hemocyanin. Depending on the host species, various adjuvants can be used to increase the immunological response. Such adjuvants include, but are not limited to, Freund's adjuvant, mineral gels (e.g., aluminum hydroxide), and surface active substances (e.g. lysolecithin, pluronic polyols, polyanions, peptides, oil emulsions, keyhole limpet hemocyanin, and dinitrophenol). Among adjuvants used in humans, BCG (bacilli Calmette-Guerin) and *Corynebacterium parvum* are especially useful.

Monoclonal antibodies which specifically bind to a wild-type or mutant GAS57 antigen can be prepared using any technique which provides for the production of antibody molecules by continuous cell lines in culture. These techniques include, but are not limited to, the hybridoma technique, the human B cell hybridoma technique, and the EBV hybridoma technique (Kohler et al., *Nature* 256, 495-97, 1985; Kozbor et al., *J. Immunol. Methods* 81, 31 42, 1985; Cote et al., *Proc. Natl. Acad. Sci.* 80, 2026-30, 1983; Cole et al., *Mol. Cell Biol.* 62, 109-20, 1984).

In addition, techniques developed for the production of "chimeric antibodies," the splicing of mouse antibody genes to human antibody genes to obtain a molecule with appropriate antigen specificity and biological activity, can be used (Morrison et al., *Proc. Natl. Acad. Sci.* 81, 6851-55, 1984; Neuberger et al., *Nature* 312, 604-08, 1984; Takeda et al., *Nature* 314, 452-54, 1985). Monoclonal and other antibodies also can be "humanized" to prevent a patient from mounting an immune response against the antibody when it is used therapeutically. Such antibodies may be sufficiently similar in sequence to human antibodies to be used directly in therapy or may require alteration of a few key residues. Sequence differences between rodent antibodies and human sequences can be minimized by replacing residues which differ from those in the human sequences by site directed mutagenesis of individual residues or by grating of entire complementarity determining regions.

Alternatively, humanized antibodies can be produced using recombinant methods, as described below. Antibodies which specifically bind to a particular antigen can contain antigen binding sites which are either partially or fully humanized, as disclosed in U.S. Pat. No. 5,565,332. Human monoclonal antibodies can be prepared in vitro as described in Simmons et al., *PLoS Medicine* 4(5), 928-36, 2007.

Alternatively, techniques described for the production of single chain antibodies can be adapted using methods known in the art to produce single chain antibodies which specifically bind to a particular antigen. Antibodies with related specificity, but of distinct idiotypic composition, can be generated by chain shuffling from random combinatorial immunoglobin libraries (Burton, *Proc. Natl. Acad. Sci.* 88, 11120-23, 1991).

Single-chain antibodies also can be constructed using a DNA amplification method, such as PCR, using hybridoma cDNA as a template (Thirion et al., *Eur. J. Cancer Prev.* 5, 507-11, 1996). Single-chain antibodies can be mono- or bispecific, and can be bivalent or tetravalent. Construction of tetravalent, bispecific single-chain antibodies is taught, for example, in Coloma & Morrison, *Nat. Biotechnol.* 15, 159-63, 1997. Construction of bivalent, bispecific single-chain antibodies is taught in Mallender & Voss, *J. Biol. Chem.* 269, 199-206, 1994.

A nucleotide sequence encoding a single-chain antibody can be constructed using manual or automated nucleotide synthesis, cloned into an expression construct using standard recombinant DNA methods, and introduced into a cell to express the coding sequence, as described below. Alternatively, single-chain antibodies can be produced directly using, for example, filamentous phage technology (Verhaar et al., *Int. J Cancer* 61, 497-501, 1995; Nicholls et al., *J. Immunol. Meth.* 165, 81-91, 1993).

Antibodies which specifically bind to a GAS57 antigen also can be produced by inducing in vivo production in the lymphocyte population or by screening immunoglobulin libraries or panels of highly specific binding reagents as disclosed in the literature (Orlandi et al., *Proc. Natl. Acad. Sci.* 86, 3833 3837, 1989; Winter et al., *Nature* 349, 293 299, 1991).

Chimeric antibodies can be constructed as disclosed in WO 93/03151. Binding proteins which are derived from immunoglobulins and which are multivalent and multispecific, such as the "diabodies" described in WO 94/13804, also can be prepared.

Antibodies can be purified by methods well known in the art. For example, antibodies can be affinity purified by passage over a column to which the relevant antigen is bound. The bound antibodies can then be eluted from the column using a buffer with a high salt concentration.

Pharmaceutical Compositions

The invention also provides compositions for use as medicaments (e.g., as immunogenic compositions or vaccines). Compositions of the invention are useful for preventing and/or treating disease caused as a result of *S. pyogenes* infection and comprise at least one active agent, which can be a polypeptide, a nucleic acid molecule, or an antibody. Said disease may be, for example, bacteremia, meningitis, puerperal fever, scarlet fever, erysipelas, pharyngitis, impetigo, necrotizing fasciitis, myositis or toxic shock syndrome.

Pharmaceutical compositions according to the invention may be used either prophylactically or therapeutically, but will typically be prophylactic. Accordingly, the invention includes a method for the therapeutic or prophylactic treatment of a *Streptococcus pyogenes* infection. The animal is preferably a mammal, most preferably a human. The methods involve administering to the animal a therapeutic or prophylactic amount of the immunogenic compositions of the invention. The invention also provides the immunogenic compositions of the invention for the therapeutic or prophylactic treatment of a *Streptococcus pyogenes* infection in an animal.

Compositions containing mutant a GAS57 antigen or a nucleic acid molecule encoding a mutant GAS57 antigen are preferably immunogenic compositions, and are more preferably vaccine compositions. The pH of such compositions preferably is between 6 and 8, preferably about 7. The pH can be maintained by the use of a buffer. The composition can be sterile and/or pyrogen free. The composition can be isotonic with respect to human tissue (e.g., blood).

Some compositions of the invention comprise one or more mutant GAS57 antigens as described herein. Other compositions of the invention comprise one or more nucleic acid molecules which encodes the mutant GAS57 antigen(s) and, optionally, other antigens which can be included in the composition (see below). See, e.g., Robinson & Torres (1997) Seminars in Immunology 9:271-283; Donnelly et al. (1997) Ann. Rev Immunol 15:617-648; Scott-Taylor & Dalgleish (2000) Expert Opin Investig Drugs 9:471-480; Apostolopoulos & Plebanski (2000) Curr Opin Mol Ther 2:441-447; Ilan (1999) Curr Opin Mol Ther 1:116-120; Dubensky et al. (2000) Mol Med 6:723-732; Robinson & Pertmer (2000) Adv Virus Res 55:1-74; Donnelly et al. (2000) Am J Respir Crit Care Med 162(4 Pt 2):S190-193; Davis (1999) Mt. Sinai J. Med. 66:84-90. Typically the nucleic acid molecule is a DNA molecule, e.g., in the form of a plasmid.

Still other compositions of the invention comprise at least one antibody which specifically binds to a wild-type GAS57 antigen as described above or a nucleic acid molecule which encodes such an antibody.

In some embodiments, compositions of the invention can comprise more than one type of active agent (e.g., a polypeptide antigen and a nucleic acid molecule; a polypeptide antigen and an antibody; a nucleic acid molecule and an antibody; a polypeptide antigen, a nucleic acid molecule, and an antibody).

In some embodiments, compositions of the invention can include one or more additional active agents. Such agents include, but are not limited to, (a) another mutant GAS57 antigen of the invention, (b) a polypeptide antigen which is useful in a pediatric vaccine, (c) a polypeptide antigen which is useful in a vaccine for elderly or immunocompromised individuals, (d) a nucleic acid molecule encoding (a)-(c), and an antibody which specifically binds to (a)-(c).

Additional Antigens

Compositions of the invention may be administered in conjunction with one or more antigens for use in therapeutic or prophylactic methods of the present invention. Preferred antigens include those listed below. Additionally, the compositions of the present invention may be used to treat or prevent infections caused by any of the below-listed pathogens. In addition to combination with the antigens described below, the compositions of the invention may also be combined with an adjuvant as described herein.

Antigens for use with the invention include, but are not limited to, one or more of the following antigens set forth below, or antigens derived from one or more of the pathogens set forth below:

A. Bacterial Antigens

Bacterial antigens suitable for use in the invention include proteins, polysaccharides, lipopolysaccharides, and outer membrane vesicles which may be isolated, purified or derived from a bacteria. In addition, bacterial antigens may include bacterial lysates and inactivated bacterial formulations. Bacteria antigens may be produced by recombinant expression. Bacterial antigens preferably include epitopes which are exposed on the surface of the bacteria during at least one stage of its life cycle. Bacterial antigens are preferably conserved across multiple serotypes. Bacterial antigens include antigens derived from one or more of the bacteria set forth below as well as the specific antigens examples identified below.

*Neisseria meningitidis:* Meningitides antigens may include proteins (such as those identified in References 1-7), saccharides (including a polysaccharide, oligosaccharide or lipopolysaccharide), or outer-membrane vesicles (References 8, 9, 10, 11) purified or derived from *N. meningitides* serogroup such as A, C, W135, Y, and/or B. *Meningitides* protein antigens may be selected from adhesions, autotransporters, toxins, Fe acquisition proteins, and membrane associated proteins (preferably integral outer membrane protein).

*Streptococcus pneumoniae:* Streptococcus pneumoniae antigens may include a saccharide (including a polysaccharide or an oligosaccharide) and/or protein from *Streptococcus pneumoniae*. Saccharide antigens may be selected from serotypes 1, 2, 3, 4, 5, 6B, 7F, 8, 9N, 9V, 10A, 11A, 12F, 14, 15B, 17F, 18C, 19A, 19F, 20, 22F, 23F, and 33F. Protein antigens may be selected from a protein identified in WO 98/18931, WO 98/18930, U.S. Pat. Nos. 6,699,703, 6,800,744, WO 97/43303, and WO 97/37026. *Streptococcus pneumoniae* proteins may be selected from the Poly Histidine Triad family (PhtX), the Choline Binding Protein family (CbpX), CbpX truncates, LytX family, LytX truncates, CbpX truncate-LytX truncate chimeric proteins, pneumolysin (Ply), PspA, PsaA, Sp128, Sp101, Sp130, Sp125 or Sp133.

*Streptococcus pyogenes* (Group A *Streptococcus*): Group A *Streptococcus* antigens may include a protein identified in WO 02/34771 or WO 2005/032582 (including GAS 40), fusions of fragments of GAS M proteins (including those described in WO 02/094851, and Dale, Vaccine (1999) 17:193-200, and Dale, Vaccine 14(10): 944-948), fibronectin binding protein (Sfb1), Streptococcal heme-associated protein (Shp), and Streptolysin S (SagA). Other Group A *Streptococcus* antigens include, but are not limited to, GAS25 (Spy0167; gi13621460) GAS39 (Spy0266; gi13621542), GAS40 (Spy0269; gi13621545), GAS42 (Spy0287; gi13621559), GAS45 (M5005_Spy0249; gi71910063), GAS58 (Spy0430; gi13621663), GAS84 (SPy1274; 13622398), GAS95 (SPy1733; 13622787), GAS117 (Spy0448; gi13621679), GAS130 (Spy0591; gi13621794), GAS137 (Spy0652; gi13621842), GAS159 (Spy1105; gi13622244), GAS193 (Spy2025; gi3623029), GAS202 (Spy1309; gi13622431), GAS217 (Spy0925, gi1362208), GAS236 (Spy1126; gi13622264), GAS253 (Spy1524; gi13622611), GAS277 (Spy1939; gi13622962), GAS294 (Spy1173; gi13622306), GAS309 (Spy0124; gi13621426), GAS366 (Spy1525; gi13622612), GAS372 (Spy1625; gi13622698), GAS384 (Spy1874; gi13622908), GAS389 (Spy1981; gi13622996), GAS504 (Spy1751; gi13622806), GAS509 (Spy1618; gi13622692), GAS290 (SPy1959; gi13622978), GAS511 (Spy1743; gi13622798), GAS527 (Spy1204; gi3622332), GAS529 (Spy1280; gi3622403), and GAS533 (Spy1877; gi13622912), GAS68 (Spy0163; gi13621456), GAS84 (Spy1274; gi13622398), GAS88 (Spy1361; gi13622470), GAS89 (Spy1390; gi13622493), GAS98 (Spy1882; gi13622916), GAS99 (Spy1979; gi13622993), GAS102 (Spy2016, gi13623025), GAS146 (Spy0763; gi13621942), GAS195 (Spy2043; gi13623043), GAS561 (Spy1134; gi13622269), GAS179 (Spy1718, gi13622773) and GAS681 (spy1152; gi1362228).

*Moraxella catarrhalis:* Moraxella antigens include antigens identified in WO 02/18595 and WO 99/58562, outer membrane protein antigens (HMW-OMP), C-antigen, and/or LPS.

*Bordetella pertussis*: Pertussis antigens include petussis holotoxin (PT) and filamentous haemagglutinin (FHA) from *B. pertussis*, optionally also combination with pertactin and/or agglutinogens 2 and 3 antigen.

*Staphylococcus aureus:* Staphylococcus aureus antigens include *S. aureus* type 5 and 8 capsular polysaccharides optionally conjugated to nontoxic recombinant *Pseudomonas aeruginosa* exotoxin A, such as StaphVAX™, or antigens derived from surface proteins, invasins (leukocidin, kinases, hyaluronidase), surface factors that inhibit phagocytic engulfment (capsule, Protein A), carotenoids, catalase production, Protein A, coagulase, clotting factor, and/or membrane-damaging toxins (optionally detoxified) that lyse eukaryotic cell membranes (hemolysins, leukotoxin, leukocidin).

*Staphylococcus epidermis:* S. epidermidis antigens include slime-associated antigen (SAA).

*Clostridium tetani* (Tetanus): Tetanus antigens include tetanus toxoid (TT), preferably used as a carrier protein in conjunction/conjugated with the compositions of the present invention.

*Cornynebacterium diphtheriae* (Diphtheria): Diphtheria antigens include diphtheria toxin, preferably detoxified, such as CRM197. Additionally antigens capable of modulating, inhibiting or associated with ADP ribosylation are contemplated for combination/co-administration/conjugation with the compositions of the present invention. The diphtheria toxoids may be used as carrier proteins.

*Haemophilus influenzae B* (Hib): Hib antigens include a Hib saccharide antigen.

*Pseudomonas aeruginosa:* Pseudomonas antigens include endotoxin A, Wzz protein, *P. aeruginosa* LPS, more particularly LPS isolated from PAO1 (O5 serotype), and/or Outer Membrane Proteins, including Outer Membrane Proteins F (OprF) (Infect Immun. 2001 May; 69(5): 3510-3515).

*Legionella pneumophila*. Bacterial antigens may be derived from *Legionella pneumophila*.

*Streptococcus agalactiae* (Group B *Streptococcus*): Group B *Streptococcus* antigens include a protein or saccharide antigen identified in WO 02/34771, WO 03/093306, WO 04/041157, or WO 2005/002619 (including proteins GBS 80, GBS 104, GBS 276 and GBS 322, and including saccharide antigens derived from serotypes Ia, Ib, Ia/c, II, III, IV, V, VI, VII and VIII).

*Neiserria gonorrhoeae:* Gonorrhoeae antigens include Por (or porin) protein, such as PorB (see Zhu et al., Vaccine (2004) 22:660-669), a transferring binding protein, such as TbpA and TbpB (See Price et al., Infection and Immunity (2004) 71(1):277-283), a opacity protein (such as Opa), a reduction-modifiable protein (Rmp), and outer membrane vesicle (OMV) preparations (see Plante et al., J Infectious Disease (2000) 182:848-855), also see e.g. WO99/24578, WO99/36544, WO99/57280, WO02/079243).

*Chlamydia trachomatis:* Chlamydia trachomatis antigens include antigens derived from serotypes A, B, Ba and C (agents of trachoma, a cause of blindness), serotypes L1, L2 & L3 (associated with *Lymphogranuloma venereum*), and serotypes, Chlamydia trachomas antigens may also include an antigen identified in WO 00/37494, WO 03/049762, WO 03/068811, or WO 05/002619, including PepA (CT045), LcrE (CT089), ArtJ (CT381), DnaK (CT396), CT398, OmpH-like (CT242), L7/L12 (CT316), OmcA (CT444), AtosS (CT467), CT547, Eno (CT587), HrtA (CT823), and MurG (CT761).

*Treponema pallidum* (Syphilis): Syphilis antigens include TmpA antigen.

*Haemophilus ducreyi* (causing chancroid): Ducreyi antigens include outer membrane protein (DsrA).

*Enterococcus faecalis* or *Enterococcus faecium*: Antigens include a trisaccharide repeat or other *Enterococcus* derived antigens provided in U.S. Pat. No. 6,756,361.

*Helicobacter pylori*: *H. pylori* antigens include Cag, Vac, Nap, HopX, HopY and/or urease antigen.

*Staphylococcus saprophyticus*: Antigens include the 160 kDa hemagglutinin of *S. saprophyticus* antigen.

*Yersinia enterocolitica* antigens include LPS (Infect Immun. 2002 August; 70(8): 4414).

*E. coli*: *E. coli* antigens may be derived from enterotoxigenic *E. coli* (ETEC), enteroaggregative *E. coli* (EAggEC), diffusely adhering *E. coli* (DAEC), enteropathogenic *E. coli* (EPEC), and/or enterohemorrhagic *E. coli* (EHEC).

*Bacillus anthracis* (anthrax): *B. anthracis* antigens are optionally detoxified and may be selected from A-components (lethal factor (LF) and edema factor (EF)), both of which can share a common B-component known as protective antigen (PA).

*Yersinia pestis* (plague): Plague antigens include F1 capsular antigen (Infect Immun. 2003 January; 71(1)): 374-383, LPS (Infect Immun. 1999 October; 67(10): 5395), *Yersinia pestis* V antigen (Infect Immun. 1997 November; 65(11): 4476-4482).

*Mycobacterium tuberculosis*: Tuberculosis antigens include lipoproteins, LPS, BCG antigens, a fusion protein of antigen 85B (Ag85B) and/or ESAT-6 optionally formulated in cationic lipid vesicles (Infect Immun. 2004 October; 72(10): 6148), *Mycobacterium tuberculosis* (Mtb) isocitrate dehydrogenase associated antigens (Proc Natl Acad Sci USA. 2004 Aug. 24; 101(34): 12652), and/or MPT51 antigens (Infect Immun. 2004 July; 72(7): 3829).

*Rickettsia*: Antigens include outer membrane proteins, including the outer membrane protein A and/or B (OmpB) (Biochim Biophys Acta. 2004 Nov. 1;1702(2):145), LPS, and surface protein antigen (SPA) (J Autoimmun. 1989 Jun.;2 Supp1:81).

*Listeria monocytogenes*. Bacterial antigens may be derived from *Listeria monocytogenes*.

*Chlamydia pneumoniae*: Antigens include those identified in WO 02/02606.

*Vibrio cholerae*: Antigens include proteinase antigens, LPS, particularly lipopolysaccharides of *Vibrio cholerae* II, O1 Inaba O-specific polysaccharides, *V. cholera* O139, antigens of IEM108 vaccine (Infect Immun. 2003 October;71 (10):5498-504), and/or Zonula occludens toxin (Zot).

*Salmonella typhi* (typhoid fever): Antigens include capsular polysaccharides preferably conjugates (Vi, i.e. vax-TyVi).

*Borrelia burgdorferi* (Lyme disease): Antigens include lipoproteins (such as OspA, OspB, OspC and OspD), other surface proteins such as OspE-related proteins (Erps), decorin-binding proteins (such as DbpA), and antigenically variable VI proteins, such as antigens associated with P39 and P13 (an integral membrane protein, Infect Immun. 2001 May; 69(5): 3323-3334), VlsE Antigenic Variation Protein (J Clin Microbiol. 1999 December; 37(12): 3997).

*Porphyromonas gingivalis*: Antigens include *P. gingivalis* outer membrane protein (OMP).

*Klebsiella*: Antigens include an OMP, including OMP A, or a polysaccharide optionally conjugated to tetanus toxoid.

Further bacterial antigens of the invention may be capsular antigens, polysaccharide antigens or protein antigens of any of the above. Further bacterial antigens may also include an outer membrane vesicle (OMV) preparation. Additionally, antigens include live, attenuated, and/or purified versions of any of the aforementioned bacteria. The antigens of the present invention may be derived from gram-negative or gram-positive bacteria. The antigens of the present invention may be derived from aerobic or anaerobic bacteria.

Additionally, any of the above bacterial-derived saccharides (polysaccharides, LPS, LOS or oligosaccharides) can be conjugated to another agent or antigen, such as a carrier protein (for example CRM197). Such conjugation may be direct conjugation effected by reductive amination of carbonyl moieties on the saccharide to amino groups on the protein, as provided in U.S. Pat. No. 5,360,897 and Can J Biochem Cell Biol. 1984 May;62(5):270-5. Alternatively, the saccharides can be conjugated through a linker, such as, with succinamide or other linkages provided in Bioconjugate Techniques, 1996 and CRC, Chemistry of Protein Conjugation and Cross-Linking, 1993.

B. Viral Antigens

Viral antigens suitable for use in the invention include inactivated (or killed) virus, attenuated virus, split virus formulations, purified subunit formulations, viral proteins which may be isolated, purified or derived from a virus, and Virus Like Particles (VLPs). Viral antigens may be derived from viruses propagated on cell culture or other substrate. Alternatively, viral antigens may be expressed recombinantly. Viral antigens preferably include epitopes which are exposed on the surface of the virus during at least one stage of its life cycle. Viral antigens are preferably conserved across multiple serotypes or isolates. Viral antigens include antigens derived from one or more of the viruses set forth below as well as the specific antigens examples identified below.

Orthomyxovirus: Viral antigens may be derived from an Orthomyxovirus, such as Influenza A, B and C. Orthomyxovirus antigens may be selected from one or more of the viral proteins, including hemagglutinin (HA), neuraminidase (NA), nucleoprotein (NP), matrix protein (M1), membrane protein (M2), one or more of the transcriptase components (PB1, PB2 and PA). Preferred antigens include HA and NA.

Influenza antigens may be derived from interpandemic (annual) flu strains. Alternatively influenza antigens may be derived from strains with the potential to cause pandemic a pandemic outbreak (i.e., influenza strains with new haemagglutinin compared to the haemagglutinin in currently circulating strains, or influenza strains which are pathogenic in avian subjects and have the potential to be transmitted horizontally in the human population, or influenza strains which are pathogenic to humans).

Paramyxoviridae viruses: Viral antigens may be derived from Paramyxoviridae viruses, such as Pneumoviruses (RSV), Paramyxoviruses (PIV) and Morbilliviruses (Measles).

Pneumovirus: Viral antigens may be derived from a Pneumovirus, such as Respiratory syncytial virus (RSV), Bovine respiratory syncytial virus, Pneumonia virus of mice, and Turkey rhinotracheitis virus. Preferably, the Pneumovirus is RSV. Pneumovirus antigens may be selected from one or more of the following proteins, including surface proteins Fusion (F), Glycoprotein (G) and Small Hydrophobic protein (SH), matrix proteins M and M2, nucleocapsid proteins N, P and L and nonstructural proteins NS1 and NS2. Preferred Pneumovirus antigens include F, G and M. See e.g., J Gen Virol. 2004 November; 85(Pt 11):3229). Pneumovirus antigens may also be formulated in or derived from chimeric viruses. For example, chimeric RSV/PIV viruses may comprise components of both RSV and PIV.

Paramyxovirus: Viral antigens may be derived from a Paramyxovirus, such as Parainfluenza virus types 1-4 (NV), Mumps, Sendai viruses, Simian virus 5, Bovine parainfluenza virus and Newcastle disease virus. Preferably, the Paramyxovirus is PIV or Mumps. Paramyxovirus antigens may be selected from one or more of the following proteins: Hemagglutinin-Neuraminidase (HN), Fusion proteins F1 and F2, Nucleoprotein (NP), Phosphoprotein (P), Large protein (L), and Matrix protein (M). Preferred Paramyxovirus proteins include HN, F1 and F2. Paramyxovirus antigens may also be formulated in or derived from chimeric viruses. For example, chimeric RSV/PIV viruses may comprise components of both RSV and PIV. Commercially available mumps vaccines include live attenuated mumps virus, in either a monovalent form or in combination with measles and rubella vaccines (MMR).

Morbillivirus: Viral antigens may be derived from a Morbillivirus, such as Measles. Morbillivirus antigens may be selected from one or more of the following proteins: hemagglutinin (H), Glycoprotein (G), Fusion factor (F), Large protein (L), Nucleoprotein (NP), Polymerase phosphoprotein (P), and Matrix (M). Commercially available measles vaccines include live attenuated measles virus, typically in combination with mumps and rubella (MMR).

Picornavirus: Viral antigens may be derived from Picornaviruses, such as Enteroviruses, Rhinoviruses, Heparnavirus, Cardioviruses and Aphthoviruses. Antigens derived from Enteroviruses, such as Polioviruses are preferred.

Enterovirus: Viral antigens may be derived from an Enterovirus, such as Poliovirus types 1, 2 or 3, Coxsackie A virus types 1 to 22 and 24, Coxsackie B virus types 1 to 6, Echovirus (ECHO) virus) types 1 to 9, 11 to 27 and 29 to 34 and Enterovirus 68 to 71. Preferably, the Enterovirus is poliovirus. Enterovirus antigens are preferably selected from one or more of the following Capsid proteins VP1, VP2, VP3 and VP4. Commercially available polio vaccines include Inactivated Polio Vaccine (IPV) and Oral poliovirus vaccine (OPV).

Heparnavirus: Viral antigens may be derived from an Heparnavirus, such as Hepatitis A virus (HAV). Commercially available HAV vaccines include inactivated HAV vaccine.

Togavirus: Viral antigens may be derived from a Togavirus, such as a Rubivirus, an Alphavirus, or an Arterivirus. Antigens derived from Rubivirus, such as Rubella virus, are preferred. Togavirus antigens may be selected from E1, E2, E3, C, NSP-1, NSPO-2, NSP-3 or NSP-4. Togavirus antigens are preferably selected from E1, E2 or E3. Commercially available Rubella vaccines include a live cold-adapted virus, typically in combination with mumps and measles vaccines (MMR).

Flavivirus: Viral antigens may be derived from a Flavivirus, such as Tick-borne encephalitis (TBE), Dengue (types 1, 2, 3 or 4), Yellow Fever, Japanese encephalitis, West Nile encephalitis, St. Louis encephalitis, Russian spring-summer encephalitis, Powassan encephalitis. Flavivirus antigens may be selected from PrM, M, C, E, NS-1, NS-2a, NS2b, NS3, NS4a, NS4b, and NS5. Flavivirus antigens are preferably selected from PrM, M and E. Commercially available TBE vaccine include inactivated virus vaccines.

Pestivirus: Viral antigens may be derived from a Pestivirus, such as Bovine viral diarrhea (BVDV), Classical swine fever (CSFV) or Border disease (BDV).

Hepadnavirus: Viral antigens may be derived from a Hepadnavirus, such as Hepatitis B virus. Hepadnavirus antigens may be selected from surface antigens (L, M and S), core antigens (HBc, HBe). Commercially available HBV vaccines include subunit vaccines comprising the surface antigen S protein.

Hepatitis C virus: Viral antigens may be derived from a Hepatitis C virus (HCV). HCV antigens may be selected from one or more of E1, E2, E1/E2, NS345 polyprotein, NS 345- core polyprotein, core, and/or peptides from the nonstructural regions (Houghton et al., Hepatology (1991) 14:381).

Rhabdovirus: Viral antigens may be derived from a Rhabdovirus, such as a Lyssavirus (Rabies virus) and Vesiculovirus (VSV). Rhabdovirus antigens may be selected from glycoprotein (G), nucleoprotein (N), large protein (L), nonstructural proteins (NS). Commercially available Rabies virus vaccine comprise killed virus grown on human diploid cells or fetal rhesus lung cells.

Caliciviridae; Viral antigens may be derived from Caliciviridae, such as Norwalk virus, and Norwalk-like Viruses, such as Hawaii Virus and Snow Mountain Virus.

Coronavirus: Viral antigens may be derived from a Coronavirus, SARS, Human respiratory coronavirus, Avian infectious bronchitis (IBV), Mouse hepatitis virus (MHV), and Porcine transmissible gastroenteritis virus (TGEV). Coronavirus antigens may be selected from spike (S), envelope (E), matrix (M), nucleocapsid (N), and Hemagglutinin-esterase glycoprotein (HE). Preferably, the Coronavirus antigen is derived from a SARS virus. SARS viral antigens are described in WO 04/92360;

Retrovirus: Viral antigens may be derived from a Retrovirus, such as an Oncovirus, a Lentivirus or a Spumavirus. Oncovirus antigens may be derived from HTLV-1, HTLV-2 or HTLV-5. Lentivirus antigens may be derived from HIV-1 or HIV-2. Retrovirus antigens may be selected from gag, pol, env, tax, tat, rex, rev, nef, vif, vpu, and vpr. HIV antigens may be selected from gag (p24gag and p55gag), env (gp160 and gp41), pol, tat, nef, rev vpu, miniproteins, (preferably p55 gag and gp140v delete). HIV antigens may be derived from one or more of the following strains: HIVIIIb, HIVSF2, HIVLAV, HIVLAI, HIVMN, HIV-1CM235, HIV-1US4.

Reovirus: Viral antigens may be derived from a Reovirus, such as an Orthoreovirus, a Rotavirus, an Orbivirus, or a Coltivirus. Reovirus antigens may be selected from structural proteins $\lambda 1$, $\lambda 2$, $\lambda 3$, $\mu 1$, $\mu 2$, $\sigma 1$, $\sigma 2$, or $\sigma 3$, or nonstructural proteins $\sigma NS$, $\mu NS$, or $\sigma 1s$. Preferred Reovirus antigens may be derived from a Rotavirus. Rotavirus antigens may be selected from VP1, VP2, VP3, VP4 (or the cleaved product VP5 and VP8), NSP 1, VP6, NSP3, NSP2, VP7, NSP4, or NSP5. Preferred Rotavirus antigens include VP4 (or the cleaved product VP5 and VP8), and VP7.

Parvovirus: Viral antigens may be derived from a Parvovirus, such as Parvovirus B19. Parvovirus antigens may be selected from VP-1, VP-2, VP-3, NS-1 and NS-2. Preferably, the Parvovirus antigen is capsid protein VP-2.

Delta hepatitis virus (HDV): Viral antigens may be derived HDV, particularly δ-antigen from HDV (see, e.g., U.S. Pat. No. 5,378,814).

Hepatitis E virus (HEV): Viral antigens may be derived from HEV.

Hepatitis G virus (HGV): Viral antigens may be derived from HGV.

Human Herpesvirus: Viral antigens may be derived from a Human Herpesvirus, such as Herpes Simplex Viruses (HSV), Varicella-zoster virus (VZV), Epstein-Barr virus (EBV), Cytomegalovirus (CMV), Human Herpesvirus 6 (HHV6), Human Herpesvirus 7 (HHV7), and Human Herpesvirus 8 (HHV8). Human Herpesvirus antigens may be selected from immediate early proteins (α), early proteins (β), and late proteins (γ). HSV antigens may be derived from HSV-1 or HSV-2 strains. HSV antigens may be selected from glycoproteins gB, gC, gD and gH, fusion protein (gB), or immune escape proteins (gC, gE, or gI). VZV antigens may be selected from core, nucleocapsid, tegument, or envelope proteins. A live attenuated VZV vaccine is commercially available. EBV antigens may be selected from early antigen (EA) proteins, viral capsid antigen (VCA), and glycoproteins of the membrane antigen (MA). CMV antigens may be selected from capsid proteins, envelope glycoproteins (such as gB and gH), and tegument proteins Papovaviruses: Antigens may be derived from Papovaviruses, such as Papillomaviruses and Polyomaviruses. Papillomaviruses include HPV serotypes 1, 2, 4, 5, 6, 8, 11, 13, 16, 18, 31, 33, 35, 39, 41, 42, 47, 51, 57, 58, 63 and 65. Preferably, HPV antigens are derived from serotypes 6, 11, 16 or 18. HPV antigens may be selected from capsid proteins (L1) and (L2), or E1-E7, or fusions thereof. HPV antigens are preferably formulated into virus-like particles (VLPs). Polyomyavirus viruses include BK virus and JK virus. Polyomavirus antigens may be selected from VP1, VP2 or VP3.

Further provided are antigens, compositions, methods, and microbes included in Vaccines, 4th Edition (Plotkin and Orenstein ed. 2004); Medical Microbiology 4th Edition (Murray et al. ed. 2002); Virology, 3rd Edition (W. K. Joklik ed. 1988); Fundamental Virology, 2nd Edition (B. N. Fields and D. M. Knipe, eds. 1991), which are contemplated in conjunction with the compositions of the present invention.

C. Fungal Antigens

Fungal antigens for use in the invention may be derived from one or more of the fungi set forth below.

Fungal antigens may be derived from *Dermatophytres*, including: *Epidermophyton floccusum, Microsporum audouini, Microsporum canis, Microsporum distortum, Microsporum equinum, Microsporum gypsum, Microsporum nanum, Trichophyton concentricum, Trichophyton equinum, Trichophyton gallinae, Trichophyton gypseum, Trichophyton megnini, Trichophyton mentagrophytes, Trichophyton quinckeanum, Trichophyton rubrum, Trichophyton schoenleini, Trichophyton tonsurans, Trichophyton verrucosum, T. verrucosum* var. *album*, var. *discoides*, var. *ochraceum*, *Trichophyton violaceum*, and/or *Trichophyton faviforme*.

Fungal pathogens may be derived from *Aspergillus fumigatus, Aspergillus flavus, Aspergillus niger, Aspergillus nidulans, Aspergillus terreus, Aspergillus sydowi, Aspergillus flavatus, Aspergillus glaucus, Blastoschizomyces capitatus, Candida albicans, Candida enolase, Candida tropicalis, Candida glabrata, Candida krusei, Candida parapsilosis, Candida stellatoidea, Candida kusei, Candida parakwsei, Candida lusitaniae, Candida pseudotropicalis, Candida guilliermondi, Cladosporium carrionii, Coccidioides immitis, Blastomyces dermatidis, Cryptococcus neoformans, Geotrichum clavatum, Histoplasma capsulatum, Klebsiella pneumoniae, Paracoccidioides brasiliensis, Pneumocystis carinii, Pythiumn insidiosum, Pityrosporum ovale, Sacharomyces cerevisae, Saccharomyces boulardii, Saccharomyces pombe, Scedosporium apiosperum, Sporothrix schenckii, Trichosporon beigelii, Toxoplasma gondii, Penicillium marneffei, Malassezia* spp., *Fonsecaea* spp., *Wangiella* spp., *Sporothrix* spp., *Basidiobolus* spp., *Conidiobolus* spp., *Rhizopus* spp, *Mucor* spp, *Absidia* spp, *Mortierella* spp, *Cunninghamella* spp, *Saksenaea* spp., *Alternaria* spp, *Curvularia* spp, *Helminthosporium* spp, *Fusarium* spp, *Aspergillus* spp, *Penicillium* spp, *Monolinia* spp, *Rhizoctonia* spp, *Paecilomyces* spp, *Pithomyces* spp, and *Cladosporium* spp.

Processes for producing a fungal antigens are well known in the art (see U.S. Pat. No. 6,333,164). In a preferred method a solubilized fraction extracted and separated from an insoluble fraction obtainable from fungal cells of which cell wall has been substantially removed or at least partially removed, characterized in that the process comprises the steps of: obtaining living fungal cells; obtaining fungal cells of which cell wall has been substantially removed or at least partially removed; bursting the fungal cells of which cell wall has been substantially removed or at least partially removed; obtaining an insoluble fraction; and extracting and separating a solubilized fraction from the insoluble fraction.

D. STD Antigens

The compositions of the invention may include one or more antigens derived from a sexually transmitted disease (STD). Such antigens may provide for prophylactis or therapy for STDs such as chlamydia, genital herpes, hepatits (such as HCV), genital warts, gonorrhoea, syphilis and/or chancroid (See, WO00/15255). Antigens may be derived from one or more viral or bacterial STDs. Viral STD antigens for use in the invention may be derived from, for example, HIV, herpes simplex virus (HSV-1 and HSV-2), human papillomavirus (HPV), and hepatitis (HCV). Bacterial STD antigens for use in the invention may be derived from, for example, *Neiserria gonorrhoeae, Chlamydia trachomatis, Treponema pallidum, Haemophilus ducreyi, E. coli*, and *Streptococcus agalactiae*. Examples of specific antigens derived from these pathogens are described above.

E. Respiratory Antigens

The compositions of the invention may include one or more antigens derived from a pathogen which causes respiratory disease. For example, respiratory antigens may be derived from a respiratory virus such as Orthomyxoviruses (influenza), Pneumovirus (RSV), Paramyxovirus (Ply), Morbillivirus (measles), Togavirus (Rubella), VZV, and Coronavirus (SARS). Respiratory antigens may be derived from a bacteria which causes respiratory disease, such as *Streptococcus pneumoniae, Pseudomonas aeruginosa, Bordetella pertussis, Mycobacterium tuberculosis, Mycoplasma pneumoniae, Chlamydia pneumoniae, Bacillus anthracia*, and *Moraxella catarrhalis*. Examples of specific antigens derived from these pathogens are described above.

F. Pediatric Vaccine Antigens

The compositions of the invention may include one or more antigens suitable for use in pediatric subjects. Pediatric subjects are typically less than about 3 years old, or less than about 2 years old, or less than about 1 years old. Pediatric antigens may be administered multiple times over the course of 6 months, 1, 2 or 3 years. Pediatric antigens may be derived from a virus which may target pediatric populations and/or a virus from which pediatric populations are susceptible to infection. Pediatric viral antigens include antigens derived from one or more of Orthomyxovirus (influenza), Pneumovirus (RSV), Paramyxovirus (PIV and Mumps), Morbillivirus (measles), Togavirus (Rubella), Enterovirus (polio), HBV, Coronavirus (SARS), and Varicella-zoster virus (VZV), Epstein Barr virus (EBV). Pediatric bacterial antigens include antigens derived from one or more of *Streptococcus pneumoniae, Neisseria meningitides, Streptococcus pyogenes* (Group A *Streptococcus*), *Moraxella catarrhalis, Bordetella pertussis, Staphylococcus aureus, Clostridium tetani* (Tetanus), *Cornynebacterium diphtheriae* (Diphtheria), *Haemophilus influenzae B* (Hib), *Pseudomonas aeruginosa, Streptococcus agalactiae* (Group B *Streptococcus*), and *E. coli*. Examples of specific antigens derived from these pathogens are described above.

G. Antigens Suitable for Use in Elderly or Immunocompromised Individuals

The compositions of the invention may include one or more antigens suitable for use in elderly or immunocompromised individuals. Such individuals may need to be vaccinated more frequently, with higher doses or with adjuvanted formulations to improve their immune response to the targeted antigens. Antigens which may be targeted for use in Elderly or Immunocompromised individuals include antigens derived from one or more of the following pathogens:

*Neisseria meningitides, Streptococcus pneumoniae, Streptococcus pyogenes* (Group A *Streptococcus*), *Moraxella catarrhalis, Bordetella pertussis, Staphylococcus aureus, Staphylococcus epidermis, Clostridium tetani* (Tetanus), *Cornynebacterium diphtheriae* (Diphtheria), *Haemophilus influenzae B* (Hib), *Pseudomonas aeruginosa, Legionella pneumophila, Streptococcus agalactiae* (Group B *Streptococcus*), *Enterococcus faecalis, Helicobacter pylori, Clamydia pneumoniae*, Orthomyxovirus (influenza), Pneumovirus (RSV), Paramyxovirus (PIV and Mumps), Morbillivirus (measles), Togavirus (Rubella), Enterovirus (polio), HBV, Coronavirus (SARS), Varicella-zoster virus (VZV), Epstein Barr virus (EBV), Cytomegalovirus (CMV). Examples of specific antigens derived from these pathogens are described above.

H. Antigens Suitable for Use in Adolescent Vaccines

The compositions of the invention may include one or more antigens suitable for use in adolescent subjects. Adolescents may be in need of a boost of a previously administered pediatric antigen. Pediatric antigens which may be suitable for use in adolescents are described above. In addition, adolescents may be targeted to receive antigens derived from an STD pathogen in order to ensure protective or therapeutic immunity before the beginning of sexual activity. STD antigens which may be suitable for use in adolescents are described above.

I. Antigen Formulations

In other aspects of the invention, methods of producing microparticles having adsorbed antigens are provided. The methods comprise: (a) providing an emulsion by dispersing a mixture comprising (i) water, (ii) a detergent, (iii) an organic solvent, and (iv) a biodegradable polymer selected from the group consisting of a poly(α-hydroxy acid), a polyhydroxy butyric acid, a polycaprolactone, a polyorthoester, a polyanhydride, and a polycyanoacrylate. The polymer is typically present in the mixture at a concentration of about 1% to about 30% relative to the organic solvent, while the detergent is typically present in the mixture at a weight-to-weight detergent-to-polymer ratio of from about 0.00001:1 to about 0.1:1 (more typically about 0.0001:1 to about 0.1:1, about 0.001:1 to about 0.1:1, or about 0.005:1 to about 0.1:1); (b) removing the organic solvent from the emulsion; and (c) adsorbing an antigen on the surface of the microparticles. In certain embodiments, the biodegradable polymer is present at a concentration of about 3% to about 10% relative to the organic solvent.

Microparticles for use herein will be formed from materials that are sterilizable, non-toxic and biodegradable. Such materials include, without limitation, poly(α-hydroxy acid), polyhydroxybutyric acid, polycaprolactone, polyorthoester, polyanhydride, PACA, and polycyanoacrylate. Preferably, microparticles for use with the present invention are derived from a poly(α-hydroxy acid), in particular, from a poly(lactide) ("PLA") or a copolymer of D,L-lactide and glycolide or glycolic acid, such as a poly(D,L-lactide-co-glycolide) ("PLG" or "PLGA"), or a copolymer of D,L-lactide and caprolactone. The microparticles may be derived from any of various polymeric starting materials which have a variety of molecular weights and, in the case of the copolymers such as PLG, a variety of lactide:glycolide ratios, the selection of which will be largely a matter of choice, depending in part on the coadministered macromolecule. These parameters are discussed more fully below.

Further antigens may also include an outer membrane vesicle (OMV) preparation.

Additional formulation methods and antigens (especially tumor antigens) are provided in U.S. patent Ser. No. 09/581,772.

J. Antigen References

The following references include antigens useful in conjunction with the compositions of the present invention:
1 International patent application WO99/24578
2 International patent application WO99/36544.
3 International patent application WO99/57280.
4 International patent application WO00/22430.
5 Tettelin et al. (2000) Science 287:1809-1815.
6 International patent application WO96/29412.
7 Pizza et al. (2000) Science 287:1816-1820.
8 PCT WO 01/52885.
9 Bjune et al. (1991) Lancet 338(8775).
10 Fuskasawa et al. (1999) Vaccine 17:2951-2958.
11 Rosenqist et al. (1998) Dev. Biol. Strand 92:323-333.
12 Constantino et al. (1992) Vaccine 10:691-698.
13 Constantino et al. (1999) Vaccine 17:1251-1263.
14 Watson (2000) Pediatr Infect Dis J 19:331-332.
15 Rubin (2000) Pediatr Clin North Am 47:269-285, v.
16 Jedrzejas (2001) Microbiol Mol Biol Rev 65:187-207.
17 International patent application filed on 3 Jul. 2001 claiming priority from GB-0016363.4; WO 02/02606; PCT IB/01/00166.
18 Kalman et al. (1999) Nature Genetics 21:385-389.
19 Read et al. (2000) Nucleic Acids Res 28:1397-406.
20 Shirai et al. (2000) J. Infect. Dis 181(Suppl 3):S524-S527.
21 International patent application WO99/27105.
22 International patent application WO00/27994.
23 International patent application WO00/37494.
24 International patent application WO99/28475.
25 Bell (2000) Pediatr Infect Dis J 19:1187-1188.
26 Iwarson (1995) APMIS 103:321-326.
27 Gerlich et al. (1990) Vaccine 8 Suppl:S63-68 & 79-80.
28 Hsu et al. (1999) Clin Liver Dis 3:901-915.
29 Gastofsson et al. (1996) N. Engl. J. Med. 334-:349-355.
30 Rappuoli et al. (1991) TIBTECH 9:232-238.
31 Vaccines (1988) eds. Plotkin & Mortimer. ISBN 0-7216-1946-0.
32 Del Guidice et al. (1998) Molecular Aspects of Medicine 19:1-70.
33 International patent application WO93/018150.
34 International patent application WO99/53310.
35 International patent application WO98/04702.
36 Ross et al. (2001) Vaccine 19:135-142.
37 Sutter et al. (2000) Pediatr Clin North Am 47:287-308.
38 Zimmerman & Spann (1999) Am Fan Physician 59:113-118, 125-126.
39 Dreensen (1997) Vaccine 15 Suppl"S2-6.
40 MMWR Morb Mortal Wkly rep 1998 Jan. 16:47(1):12, 9.
41 McMichael (2000) Vaccine 19 Suppl 1:S101-107.
42 Schuchat (1999) Lancer 353(9146):51-6.
43 GB patent applications 0026333.5, 0028727.6 & 0105640.7.
44 Dale (1999) Infect Disclin North Am 13:227-43, viii.
45 Ferretti et al. (2001) PNAS USA 98: 4658-4663.
46 Kuroda et al. (2001) Lancet 357(9264):1225-1240; see also pages 1218-1219.
47 Ramsay et al. (2001) Lancet 357(9251):195-196.
48 Lindberg (1999) Vaccine 17 Suppl 2:S28-36.
49 Buttery & Moxon (2000) J R Coil Physicians Long 34:163-168.
50 Ahmad & Chapnick (1999) Infect Dis Clin North Am 13:113-133, vii.
51 Goldblatt (1998) J. Med. Microbiol. 47:663-567.
52 European patent 0 477 508.

53 U.S. Pat. No. 5,306,492.
54 International patent application WO98/42721.
55 Conjugate Vaccines (eds. Cruse et al.) ISBN 3805549326, particularly vol. 10:48-114.
56 Hermanson (1996) Bioconjugate Techniques ISBN: 012323368 & 012342335X.
57 European patent application 0372501.
58 European patent application 0378881.
59 European patent application 0427347.
60 International patent application WO93/17712.
61 International patent application WO98/58668.
62 European patent application 0471177.
63 International patent application WO00/56360.
64 International patent application WO00/67161.

The contents of all of the above cited patents, patent applications and journal articles are incorporated by reference as if set forth fully herein.

Where a saccharide or carbohydrate antigen is used, it is preferably conjugated to a carrier protein in order to enhance immunogenicity. See Ramsay et al. (2001) Lancet 357(9251): 195-196; Lindberg (1999) Vaccine 17 Suppl 2:S28-36; Buttery & Moxon (2000) J R Coll Physicians Lond 34:163-168; Ahmad & Chapnick (1999) Infect Dis Clin North Am 13:113-133, vii; Goldblatt (1998) J. Med. Microbiol. 47:563-567; European patent 0 477 508; U.S. Pat. No. 5,306,492; WO98/42721; Conjugate Vaccines (eds. Cruse et al.) ISBN 3805549326, particularly vol. 10:48-114; Hermanson (1996) Bioconjugate Techniques ISBN: 0123423368 or 012342335X. Preferred carrier proteins are bacterial toxins or toxoids, such as diphtheria or tetanus toxoids. The CRM197 diphtheria toxoid is particularly preferred.

Other carrier polypeptides include the *N. meningitidis* outer membrane protein (EP-A-0372501), synthetic peptides (EP-A-0378881 and EP-A 0427347), heat shock proteins (WO 93/17712 and WO 94/03208), pertussis proteins (WO 98/58668 and EP A 0471177), protein D from *H. influenzae* (WO 00/56360), cytokines (WO 91/01146), lymphokines, hormones, growth factors, toxin A or B from *C. difficile* (WO 00/61761), iron-uptake proteins (WO 01/72337), etc. Where a mixture comprises capsular saccharide from both serigraphs A and C, it may be preferred that the ratio (w/w) of MenA saccharide:MenC saccharide is greater than 1 (e.g., 2:1, 3:1, 4:1, 5:1, 10:1 or higher). Different saccharides can be conjugated to the same or different type of carrier protein. Any suitable conjugation reaction can be used, with any suitable linker where necessary.

Toxic protein antigens may be detoxified where necessary e.g., detoxification of pertussis toxin by chemical and/or genetic means.

Pharmaceutically Acceptable Carriers

Compositions of the invention will typically, in addition to the components mentioned above, comprise one or more "pharmaceutically acceptable carriers." These include any carrier which does not itself induce the production of antibodies harmful to the individual receiving the composition. Suitable carriers typically are large, slowly metabolized macromolecules such as proteins, polysaccharides, polylactic acids, polyglycolic acids, polymeric amino acids, amino acid copolymers, and lipid aggregates (such as oil droplets or liposomes). Such carriers are well known to those of ordinary skill in the art. A composition may also contain a diluent, such as water, saline, glycerol, etc. Additionally, an auxiliary substance, such as a wetting or emulsifying agent, pH buffering substance, and the like, may be present. A thorough discussion of pharmaceutically acceptable components is available in Gennaro (2000) Remington: The Science and Practice of Pharmacy. 20th ed., ISBN: 0683306472.

Immunoregulatory Agents

Adjuvants

Vaccines of the invention may be administered in conjunction with other immunoregulatory agents. In particular, compositions will usually include an adjuvant. Adjuvants for use with the invention include, but are not limited to, one or more of the following set forth below:

A. Mineral Containing Compositions

Mineral containing compositions suitable for use as adjuvants in the invention include mineral salts, such as aluminum salts and calcium salts. The invention includes mineral salts such as hydroxides (e.g. oxyhydroxides), phosphates (e.g. hydroxyphosphates, orthophosphates), sulfates, etc. (e.g. see chapters 8 & 9 of Vaccine Design ... (1995) eds. Powell & Newman. ISBN: 030644867X. Plenum.), or mixtures of different mineral compounds (e.g. a mixture of a phosphate and a hydroxide adjuvant, optionally with an excess of the phosphate), with the compounds taking any suitable form (e.g. gel, crystalline, amorphous, etc.), and with adsorption to the salt(s) being preferred. The mineral containing compositions may also be formulated as a particle of metal salt (WO00/23105).

Aluminum salts may be included in vaccines of the invention such that the dose of $Al^{3+}$ is between 0.2 and 1.0 mg per dose.

In one embodiment the aluminum based adjuvant for use in the present invention is alum (aluminum potassium sulfate ($AlK(SO_4)_2$)), or an alum derivative, such as that formed in-situ by mixing an antigen in phosphate buffer with alum, followed by titration and precipitation with a base such as ammonium hydroxide or sodium hydroxide.

Another aluminum-based adjuvant for use in vaccine formulations of the present invention is aluminum hydroxide adjuvant ($Al(OH)_3$) or crystalline aluminum oxyhydroxide (AlOOH), which is an excellent adsorbant, having a surface area of approximately 500 $m^2/g$. Alternatively, aluminum phosphate adjuvant ($AlPO_4$) or aluminum hydroxyphosphate, which contains phosphate groups in place of some or all of the hydroxyl groups of aluminum hydroxide adjuvant is provided. Preferred aluminum phosphate adjuvants provided herein are amorphous and soluble in acidic, basic and neutral media.

In another embodiment the adjuvant of the invention comprises both aluminum phosphate and aluminum hydroxide. In a more particular embodiment thereof, the adjuvant has a greater amount of aluminum phosphate than aluminum hydroxide, such as a ratio of 2:1, 3:1, 4:1, 5:1, 6:1, 7:1, 8:1, 9:1 or greater than 9:1, by weight aluminum phosphate to aluminum hydroxide. More particular still, aluminum salts in the vaccine are present at 0.4 to 1.0 mg per vaccine dose, or 0.4 to 0.8 mg per vaccine dose, or 0.5 to 0.7 mg per vaccine dose, or about 0.6 mg per vaccine dose.

Generally, the preferred aluminum-based adjuvant(s), or ratio of multiple aluminum-based adjuvants, such as aluminum phosphate to aluminum hydroxide is selected by optimization of electrostatic attraction between molecules such that the antigen carries an opposite charge as the adjuvant at the desired pH. For example, aluminum phosphate adjuvant (isoelectric point=4) adsorbs lysozyme, but not albumin at pH 7.4. Should albumin be the target, aluminum hydroxide adjuvant would be selected (iep 11.4). Alternatively, pretreatment of aluminum hydroxide with phosphate lowers its isoelectric point, making it a preferred adjuvant for more basic antigens.

B. Oil-Emulsions

Oil-emulsion compositions suitable for use as adjuvants in the invention include squalene-water emulsions, such as MF59 (5% Squalene, 0.5% TWEEN™ 80, and 0.5% Span 85, formulated into submicron particles using a microfluidizer). See WO90/14837. See also, Podda, Vaccine (2001) 19: 2673-2680; Frey et al., Vaccine (2003) 21:4234-4237. MF59 is used as the adjuvant in the FLUAD™ influenza virus trivalent subunit vaccine.

Particularly preferred adjuvants for use in the compositions are submicron oil-in-water emulsions. Preferred submicron oil-in-water emulsions for use herein are squalene/water emulsions optionally containing varying amounts of MTP-PE, such as a submicron oil-in-water emulsion containing 4-5% w/v squalene, 0.25-1.0% w/v TWEEN™ 80☐ (polyoxyelthylenesorbitan monooleate), and/or 0.25-1.0% SPAN 85™ (sorbitan trioleate), and, optionally, N-acetylmuramyl-L-alanyl-D-isogluatminyl-L-alanine-2-(1'-2'-dipalmitoyl-sn-glycero-3-huydroxyphosphophoryloxy)-ethylamine (MTP-PE), for example, the submicron oil-in-water emulsion known as "MF59" (International Publication No. WO90/14837; U.S. Pat. Nos. 6,299,884 and 6,451,325, and Ott et al., in Vaccine Design: The Subunit and Adjuvant Approach (Powell, M. F. and Newman, M. J. eds.) Plenum Press, New York, 1995, pp. 277-296). MF59 contains 4-5% w/v Squalene (e.g. 4.3%), 0.25-0.5% w/v TWEEN™ 80, and 0.5% w/v SPAN 85™ and optionally contains various amounts of MTP-PE, formulated into submicron particles using a microfluidizer such as Model 110Y microfluidizer (Microfluidics, Newton, Mass.). For example, MTP-PE may be present in an amount of about 0-500 μg/dose, more preferably 0-250 μg/dose and most preferably, 0-100 μg/dose. As used herein, the term "MF59-0" refers to the above submicron oil-in-water emulsion lacking MTP-PE, while the term MF59-MTP denotes a formulation that contains MTP-PE. For instance, "MF59-100" contains 100 μg MTP-PE per dose, and so on. MF69, another submicron oil-in-water emulsion for use herein, contains 4.3% w/v squalene, 0.25% w/v TWEEN™ 80, and 0.75% w/v SPAN 85™ and optionally MTP-PE. Yet another submicron oil-in-water emulsion is MF75, also known as SAF, containing 10% squalene, 0.4% TWEEN™ 80, 5% pluronic-blocked polymer L121, and thr-MDP, also microfluidized into a submicron emulsion. MF75-MTP denotes an MF75 formulation that includes MTP, such as from 100-400 μg MTP-PE per dose.

Submicron oil-in-water emulsions, methods of making the same and immunostimulating agents, such as muramyl peptides, for use in the compositions, are described in detail in WO90/14837 and U.S. Pat. Nos. 6,299,884 and 6,451,325.

Complete Freund's adjuvant (CFA) and incomplete Freund's adjuvant (IFA) may also be used as adjuvants in the invention.

C. Saponin Formulations

Saponin formulations, may also be used as adjuvants in the invention. Saponins are a heterologous group of sterol glycosides and triterpenoid glycosides that are found in the bark, leaves, stems, roots and even flowers of a wide range of plant species. Saponins isolated from the bark of the *Quillaia saponaria* Molina tree have been widely studied as adjuvants. Saponins can also be commercially obtained from *Smilax ornata* (sarsaprilla), *Gypsophilla paniculata* (brides veil), and *Saponaria officianalis* (soap root). Saponin adjuvant formulations include purified formulations, such as QS21, as well as lipid formulations, such as ISCOMs.

Saponin compositions have been purified using High Performance Thin Layer Chromatography (HP-TLC) and Reversed Phase High Performance Liquid Chromatography (RP-HPLC). Specific purified fractions using these techniques have been identified, including QS7, QS17, QS18, QS21, QH-A, QH-B and QH-C. Preferably, the saponin is QS21. A method of production of QS21 is disclosed in U.S. Pat. No. 5,057,540. Saponin formulations may also comprise a sterol, such as cholesterol (see WO96/33739).

Combinations of saponins and cholesterols can be used to form unique particles called Immunostimulating Complexes (ISCOMs). ISCOMs typically also include a phospholipid such as phosphatidylethanolamine or phosphatidylcholine. Any known saponin can be used in ISCOMs. Preferably, the ISCOM includes one or more of Quil A, QHA and QHC. ISCOMs are further described in EP0109942, WO96/11711 and WO96/33739. Optionally, the ISCOMS may be devoid of (an) additional detergent(s). See WO00/07621.

A review of the development of saponin based adjuvants can be found in Barr, et al., Advanced Drug Delivery Reviews (1998) 32:247-271. See also Sjolander, et al., Advanced Drug Delivery Reviews (1998) 32:321-338.

D. Virosomes and Virus Like Particles (VLPs)

Virosomes and Virus Like Particles (VLPs) can also be used as adjuvants in the invention. These structures generally contain one or more proteins from a virus optionally combined or formulated with a phospholipid. They are generally non-pathogenic, non-replicating and generally do not contain any of the native viral genome. The viral proteins may be recombinantly produced or isolated from whole viruses. These viral proteins suitable for use in virosomes or VLPs include proteins derived from influenza virus (such as HA or NA), Hepatitis B virus (such as core or capsid proteins), Hepatitis E virus, measles virus, Sindbis virus, Rotavirus, Foot-and-Mouth Disease virus, Retrovirus, Norwalk virus, human Papilloma virus, HIV, RNA-phages, Qβ-phage (such as coat proteins), GA-phage, fr-phage, AP205 phage, and Ty (such as retrotransposon Ty protein p1). VLPs are discussed further in WO03/024480, WO03/024481, and Niikura et al., Virology (2002) 293:273-280; Lenz et al., Journal of Immunology (2001) 5246-5355; Pinto, et al., Journal of Infectious Diseases (2003) 188:327-338; and Gerber et al., Journal of Virology (2001) 75(10):4752-4760. Virosomes are discussed further in, for example, Gluck et al., Vaccine (2002) 20:B10-B16. Immunopotentiating reconstituted influenza virosomes (IRIV) are used as the subunit antigen delivery system in the intranasal trivalent INFLEXAL™ product {Mischler & Metcalfe (2002) Vaccine 20 Suppl 5:B17-23} and the INFLUVAC PLUS™ product.

E. Bacterial or Microbial Derivatives

Adjuvants suitable for use in the invention include bacterial or microbial derivatives such as:

(1) Non-toxic Derivatives of Enterobacterial Lipopolysaccharide (LPS)

Such derivatives include Monophosphoryl lipid A (MPL) and 3-O-deacylated MPL (3dMPL). 3dMPL is a mixture of 3 De-O-acylated monophosphoryl lipid A with 4, 5 or 6 acylated chains. A preferred "small particle" form of 3 De-O-acylated monophosphoryl lipid A is disclosed in EP 0 689 454. Such "small particles" of 3dMPL are small enough to be sterile filtered through a 0.22 micron membrane (see EP 0 689 454). Other non-toxic LPS derivatives include monophosphoryl lipid A mimics, such as aminoalkyl glucosaminide phosphate derivatives e.g. RC 529. See Johnson et al. (1999) Bioorg Med Chem Lett 9:2273-2278.

(2) Lipid A Derivatives

Lipid A derivatives include derivatives of lipid A from *Escherichia coli* such as OM-174. OM-174 is described for example in Meraldi et al., Vaccine (2003) 21:2485-2491; and Pajak, et al., Vaccine (2003) 21:836-842.

(3) Immunostimulatory Oligonucleotides

Immunostimulatory oligonucleotides suitable for use as adjuvants in the invention include nucleotide sequences containing a CpG motif (a sequence containing an unmethylated cytosine followed by guanosine and linked by a phosphate bond). Bacterial double stranded RNA or oligonucleotides containing palindromic or poly(dG) sequences have also been shown to be immunostimulatory.

The CpGs can include nucleotide modifications/analogs such as phosphorothioate modifications and can be double-stranded or single-stranded. Optionally, the guanosine may be replaced with an analog such as 2'-deoxy-7-deazaguanosine. See Kandimalla, et al., Nucleic Acids Research (2003) 31(9): 2393-2400; WO02/26757 and WO99/62923 for examples of possible analog substitutions. The adjuvant effect of CpG oligonucleotides is further discussed in Krieg, Nature Medicine (2003) 9(7): 831-835; McCluskie, et al., FEMS Immunology and Medical Microbiology (2002) 32:179-185; WO98/40100; U.S. Pat. Nos. 6,207,646; 6,239,116 and 6,429,199.

The CpG sequence may be directed to TLR9, such as the motif GTCGTT or TTCGTT. See Kandimalla, et al., Biochemical Society Transactions (2003) 31 (part 3): 654-658. The CpG sequence may be specific for inducing a Th1 immune response, such as a CpG-A ODN, or it may be more specific for inducing a B cell response, such a CpG-B ODN. CpG-A and CpG-B ODNs are discussed in Blackwell, et al., J. Immunol. (2003) 170(8):4061-4068; Krieg, TRENDS in Immunology (2002) 23(2): 64-65 and WO01/95935. Preferably, the CpG is a CpG-A ODN.

Preferably, the CpG oligonucleotide is constructed so that the 5' end is accessible for receptor recognition. Optionally, two CpG oligonucleotide sequences may be attached at their 3' ends to form "immunomers". See, for example, Kandimalla, et al., BBRC (2003) 306:948-953; Kandimalla, et al., Biochemical Society Transactions (2003) 31 (part 3):664-658; Bhagat et al., BBRC (2003) 300:853-861 and WO03/035836.

(4) ADP-ribosylating Toxins and Detoxified Derivatives Thereof.

Bacterial ADP-ribosylating toxins and detoxified derivatives thereof may be used as adjuvants in the invention. Preferably, the protein is derived from *E. coli* (i.e., *E. coli* heat labile enterotoxin "LT), cholera ("CT"), or pertussis ("PT"). The use of detoxified ADP-ribosylating toxins as mucosal adjuvants is described in WO95/17211 and as parenteral adjuvants in WO98/42375. Preferably, the adjuvant is a detoxified LT mutant such as LT-K63, LT-R72, and LTR192G. The use of ADP-ribosylating toxins and detoxified derivatives thereof, particularly LT-K63 and LT-R72, as adjuvants can be found in the following references: Beignon et al., Infection and Immunity (2002) 70(6):3012-3019; Pizza, et al., Vaccine (2001) 19:2534-2541; Pizza, et al., Int. J. Med. Microbiol (2000) 290(4-5):455-461; Scharton-Kersten et al., Infection and Immunity (2000) 68(9):5306-5313; Ryan et al., Infection and Immunity (1999) 67(12):6270-6280; Partidos et al., Immunol. Lett. (1999) 67(3):209-216; Peppoloni et al., Vaccines (2003) 2(2):285-293; and Pine et al., (2002) J. Control Release (2002) 85(1-3):263-270. Numerical reference for amino acid substitutions is preferably based on the alignments of the A and B subunits of ADP-ribosylating toxins set forth in Domenighini et al., Mol. Microbiol (1995) 15(6): 1165-1167.

F. Bioadhesives and Mucoadhesives

Bioadhesives and mucoadhesives may also be used as adjuvants in the invention. Suitable bioadhesives include esterified hyaluronic acid microspheres (Singh et al. (2001) J. Cont. Rele. 70:267-276) or mucoadhesives such as cross-linked derivatives of polyacrylic acid, polyvinyl alcohol, polyvinyl pyrrolidone, polysaccharides and carboxymethylcellulose. Chitosan and derivatives thereof may also be used as adjuvants in the invention. See WO99/27960.

G. Microparticles

Microparticles may also be used as adjuvants in the invention. Microparticles (i.e. a particle of ~100 nm to ~150 μm in diameter, more preferably ~200 nm to ~30 μm in diameter, and most preferably ~500 nm to ~10 μm in diameter) formed from materials that are biodegradable and non toxic (e.g. a poly(α-hydroxy acid), a polyhydroxybutyric acid, a polyorthoester, a polyanhydride, a polycaprolactone, etc.), with poly(lactide co glycolide) are preferred, optionally treated to have a negatively-charged surface (e.g. with SDS) or a positively-charged surface (e.g. with a cationic detergent, such as CTAB).

H. Liposomes

Examples of liposome formulations suitable for use as adjuvants are described in U.S. Pat. Nos. 6,090,406, 5,916,588, and EP 0 626 169.

I. Polyoxyethylene Ether and Polyoxyethylene Ester Formulations

Adjuvants suitable for use in the invention include polyoxyethylene ethers and polyoxyethylene esters. WO99/52549. Such formulations further include polyoxyethylene sorbitan ester surfactants in combination with an octoxynol (WO01/21207) as well as polyoxyethylene alkyl ethers or ester surfactants in combination with at least one additional non-ionic surfactant such as an octoxynol (WO01/21152).

Preferred polyoxyethylene ethers are selected from the following group: polyoxyethylene-9-lauryl ether (laureth 9), polyoxyethylene-9-steoryl ether, polyoxytheylene-8-steoryl ether, polyoxyethylene-4-lauryl ether, polyoxyethylene-35-lauryl ether, and polyoxyethylene-23-lauryl ether.

J. Polyphosphazene (PCPP)

PCPP formulations are described, for example, in Andrianov et al., "Preparation of hydrogel microspheres by coacervation of aqueous polyphophazene solutions", Biomaterials (1998) 19(1-3):109-115 and Payne et al., "Protein Release from Polyphosphazene Matrices", Adv. Drug. Delivery Review (1998) 31(3):185-196.

K. Muramyl Peptides

Examples of muramyl peptides suitable for use as adjuvants in the invention include N-acetyl-muramyl-L-threonyl-D-isoglutamine (thr-MDP), N-acetyl-normuramyl-1-alanyl-d-isoglutamine (nor-MDP), and N acetylmuramyl-1-alanyl-d-isoglutaminyl-1-alanine-2-(1'-2'-dipalmitoyl-sn-glycero-3-hydroxyphosphoryloxy)-ethylamine MTP-PE).

L. Imidazoquinoline Compounds.

Examples of imidazoquinoline compounds suitable for use adjuvants in the invention include Imiquimod and its analogues, described further in Stanley, Clin Exp Dermatol (2002) 27(7):571-577; Jones, Curr Opin Investig Drugs (2003) 4(2):214-218; and U.S. Pat. Nos. 4,689,338, 5,389,640, 5,268,376, 4,929,624, 5,266,575, 5,352,784, 5,494,916, 5,482,936, 5,346,905, 5,395,937, 5,238,944, and 5,525,612.

M. Thiosemicarbazone Compounds.

Examples of thiosemicarbazone compounds, as well as methods of formulating, manufacturing, and screening for compounds all suitable for use as adjuvants in the invention include those described in WO04/60308. The thiosemicarbazones are particularly effective in the stimulation of human peripheral blood mononuclear cells for the production of cytokines, such as TNF-α.

N. Tryptanthrin Compounds.

Examples of tryptanthrin compounds, as well as methods of formulating, manufacturing, and screening for compounds all suitable for use as adjuvants in the invention include those described in WO04/64759. The tryptanthrin compounds are particularly effective in the stimulation of human peripheral blood mononuclear cells for the production of cytokines, such as TNF-α.

The invention may also comprise combinations of aspects of one or more of the adjuvants identified above. For example, the following adjuvant compositions may be used in the invention:

(1) a saponin and an oil-in-water emulsion (WO99/11241);
(2) a saponin (e.g., QS21)+a non-toxic LPS derivative (e.g. 3dMPL) (see WO94/00153);
(3) a saponin (e.g., QS21)+a non-toxic LPS derivative (e.g. 3dMPL)+a cholesterol;
(4) a saponin (e.g., QS21)+3dMPL+IL 12 (optionally+a sterol) (WO98/57659);
(5) combinations of 3dMPL with, for example, QS21 and/or oil-in-water emulsions (See European patent applications 0835318, 0735898 and 0761231);
(6) SAF, containing 10% Squalane, 0.4% Tween 80, 5% pluronic-block polymer L121, and thr-MDP, either microfluidized into a submicron emulsion or vortexed to generate a larger particle size emulsion.
(7) RIBI™ adjuvant system (RAS), (Ribi Immunochem) containing 2% Squalene, 0.2% Tween 80, and one or more bacterial cell wall components from the group consisting of monophosphorylipid A (MPL), trehalose dimycolate (TDM), and cell wall skeleton (CWS), preferably MPL+CWS (DETOX™); and
(8) one or more mineral salts (such as an aluminum salt)+a non-toxic derivative of LPS (such as 3dPML).
(9) one or more mineral salts (such as an aluminum salt)+ an immunostimulatory oligonucleotide (such as a nucleotide sequence including a CpG motif).

O. Human Immunomodulators

Human immunomodulators suitable for use as adjuvants in the invention include cytokines, such as interleukins (e.g. IL-1, IL-2, IL-4, IL-5, IL-6, IL-7, IL-12, etc.), interferons (e.g. interferon-γ), macrophage colony stimulating factor, and tumor necrosis factor.

Aluminum salts and MF59 are preferred adjuvants for use with injectable influenza vaccines. Bacterial toxins and bioadhesives are preferred adjuvants for use with mucosally-delivered vaccines, such as nasal vaccines.

The contents of all of the above cited patents, patent applications and journal articles are incorporated by reference as if set forth fully herein.

Therapeutic Methods

The invention provides the compositions described above for use in therapy, The invention provides the compositions described above for inducing or increasing an immune response to *S. pyogenes*. The invention provides methods for inducing or increasing an immune response to *S. pyogenes* using the compositions described above. The immune response is preferably protective and can include antibodies and/or cell-mediated immunity (including systemic and mucosal immunity). Immune responses include booster responses.

Teenagers and children, including toddles and infants, can receive a vaccine for prophylactic use; therapeutic vaccines typically are administered to teenagers or adults. A vaccine intended for children may also be administered to adults e.g., to assess safety, dosage, immunogenicity, etc.

Diseases caused by *Streptococcus pyogenes* which can be prevented or treated according to the invention include, but are not limited to, pharyngitis (such as streptococcal sore throat), scarlet fever, impetigo, erysipelas, cellulitis, septicemia, toxic shock syndrome, necrotizing fasciitis, and sequelae such as rheumatic fever and acute glomerulonephritis. The compositions may also be effective against other streptococcal bacteria, e.g., GBS.

Tests to Determine the Efficacy of the Immune Response

One way of assessing efficacy of therapeutic treatment involves monitoring GAS infection after administration of the composition of the invention. One way of assessing efficacy of prophylactic treatment involves monitoring immune responses against the mutant GAS57 antigens in the compositions of the invention after administration of the composition.

Another way of assessing the immunogenicity of the component proteins of the immunogenic compositions of the present invention is to mutant GAS57 antigens recombinantly and to screen patient sera or mucosal secretions by immunoblot. A positive reaction between the protein and the patient serum indicates that the patient has previously mounted an immune response to the protein in question; i.e., the protein is an immunogen. This method may also be used to identify immunodominant proteins and/or epitopes.

Another way of checking efficacy of therapeutic treatment involves monitoring GAS infection after administration of the compositions of the invention. One way of checking efficacy of prophylactic treatment involves monitoring immune responses both systemically (such as monitoring the level of IgG1 and IgG2a production) and mucosally (such as monitoring the level of IgA production) against GAS57 after administration of the composition. Typically, serum specific antibody responses are determined post-immunization but pre-challenge whereas mucosal specific antibody body responses are determined post-immunization and post-challenge.

The vaccine compositions of the present invention can be evaluated in in vitro and in vivo animal models prior to host, e.g., human, administration. Particularly useful mouse models include those in which intraperitoneal immunization is followed by either intraperitoneal challenge or intranasal challenge.

The efficacy of immunogenic compositions of the invention can also be determined in vivo by challenging animal models with GAS, e.g., guinea pigs or mice, with the immunogenic compositions. The immunogenic compositions may or may not be derived from the same serotypes as the challenge serotypes.

In vivo efficacy models include but are not limited to: (i) a murine infection model using human GAS serotypes; (ii) a murine disease model which is a murine model using a mouse-adapted GAS strain, such as the M23 strain which is particularly virulent in mice, and (iii) a primate model using human GAS isolates.

The immune response may be one or both of a Th1 immune response and a Th2 response. The immune response may be an improved or an enhanced or an altered immune response. The immune response may be one or both of a systemic and a mucosal immune response. Preferably the immune response is an enhanced system and/or mucosal response.

An enhanced systemic and/or mucosal immunity is reflected in an enhanced Th1 and/or Th2 immune response. Preferably, the enhanced immune response includes an increase in the production of IgG1 and/or IgG2a and/or IgA.

Preferably the mucosal immune response is a Th2 immune response. Preferably, the mucosal immune response includes an increase in the production of IgA.

Activated Th2 cells enhance antibody production and are therefore of value in responding to extracellular infections. Activated Th2 cells may secrete one or more of IL-4, IL-5, IL-6, and IL-10. A Th2 immune response may result in the production of IgG1, IgE, IgA and memory B cells for future protection.

A Th2 immune response may include one or more of an increase in one or more of the cytokines associated with a Th2 immune response (such as IL-4, IL-5, IL-6 and IL-10), or an increase in the production of IgG1, IgE, IgA and memory B cells. Preferably, the enhanced Th2 immune response will include an increase in IgG1 production.

A Th1 immune response may include one or more of an increase in CTLs, an increase in one or more of the cytokines associated with a Th1 immune response (such as IL-2, IFNγ, and TNFβ), an increase in activated macrophages, an increase in NK activity, or an increase in the production of IgG2a. Preferably, the enhanced Th1 immune response will include an increase in IgG2a production.

Immunogenic compositions of the invention, in particular, immunogenic composition comprising one or more mutant GAS57 antigens of the present invention may be used either alone or in combination with other GAS antigens optionally with an immunoregulatory agent capable of eliciting a Th1 and/or Th2 response.

The invention also comprises an immunogenic composition comprising one or more immunoregulatory agent, such as a mineral salt, such as an aluminium salt and an oligonucleotide containing a CpG motif. Most preferably, the immunogenic composition includes both an aluminium salt and an oligonucleotide containing a CpG motif. Alternatively, the immunogenic composition includes an ADP ribosylating toxin, such as a detoxified ADP ribosylating toxin and an oligonucleotide containing a CpG motif. Preferably, one or more of the immunoregulatory agents include an adjuvant. The adjuvant may be selected from one or more of the group consisting of a Th1 adjuvant and Th2 adjuvant.

The compositions of the invention will preferably elicit both a cell mediated immune response as well as a humoral immune response in order to effectively address a GAS infection. This immune response will preferably induce long lasting (e.g., neutralizing) antibodies and a cell mediated immunity that can quickly respond upon exposure to one or more GAS antigens.

In one particularly preferred embodiment, the immunogenic composition comprises one or more mutant GAS57 antigen(s) which elicit(s) a neutralizing antibody response and one or more mutant GAS57 antigen(s) which elicit(s) a cell mediated immune response. In this way, the neutralizing antibody response prevents or inhibits an initial GAS infection while the cell-mediated immune response capable of eliciting an enhanced Th1 cellular response prevents further spreading of the GAS infection.

Compositions of the invention will generally be administered directly to a patient. The compositions of the present invention may be administered, either alone or as part of a composition, via a variety of different routes. Certain routes may be favored for certain compositions, as resulting in the generation of a more effective immune response, preferably a CMI response, or as being less likely to induce side effects, or as being easier for administration.

Delivery methods include parenteral injection (e.g., subcutaneous, intraperitoneal, intravenous, intramuscular, or interstitial injection) and rectal, oral (e.g., tablet, spray), vaginal, topical, transdermal (e.g., see WO 99/27961), transcutaneous (e.g., see WO02/074244 and WO02/064162), intranasal (e.g., see WO03/028760), ocular, aural, and pulmonary or other mucosal administration.

By way of example, the compositions of the present invention may be administered via a systemic route or a mucosal route or a transdermal route or it may be administered directly into a specific tissue. As used herein, the term "systemic administration" includes but is not limited to any parenteral routes of administration. In particular, parenteral administration includes but is not limited to subcutaneous, intraperitoneal, intravenous, intraarterial, intramuscular, or intrasternal injection, intravenous, intraarterial, or kidney dialytic infusion techniques. Preferably, the systemic, parenteral administration is intramuscular injection. As used herein, the term "mucosal administration" includes but is not limited to oral, intranasal, intravaginal, intrarectal, intratracheal, intestinal and ophthalmic administration.

Dosage treatment can be a single dose schedule or a multiple dose schedule. Multiple doses may be used in a primary immunization schedule and/or in a booster immunization schedule. In a multiple dose schedule the various doses may be given by the same or different routes e.g., a parenteral prime and mucosal boost, a mucosal prime and parenteral boost, etc.

The compositions of the invention may be prepared in various forms. For example, a composition can be prepared as an injectable, either as a liquid solution or a suspension. Solid forms suitable for solution in, or suspension in, liquid vehicles prior to injection can also be prepared (e.g., a lyophilized composition). A composition can be prepared for oral administration, such as a tablet or capsule, as a spray, or as a syrup (optionally flavored). A composition can be prepared for pulmonary administration, e.g., as an inhaler, using a fine powder or a spray. A composition can be prepared as a suppository or pessary. A composition can be prepared for nasal, aural or ocular administration e.g., as drops. A composition can be in kit form, designed such that a combined composition is reconstituted just prior to administration to a patient. Such kits may comprise one or more mutant GAS57 or other antigens in liquid form and one or more lyophilized antigens.

Immunogenic compositions used as vaccines comprise an immunologically effective amount of mutant GAS57 or other antigens (or nucleic acid molecules encoding the antigens), as well as any other components, as needed, such as antibiotics. An "immunologically effective amount" is an amount which, when administered to an individual, either in a single dose or as part of a series, increases a measurable immune response or prevents or reduces a clinical symptom.

The immunogenic compositions of the present invention may be administered in combination with an antibiotic treatment regime. In one embodiment, the antibiotic is administered prior to administration of the antigen of the invention or the composition comprising the one or more mutant GAS57 antigens of the invention.

In another embodiment, the antibiotic is administered subsequent to the administration of a mutant GAS57 antigen of the invention. Examples of antibiotics suitable for use in the treatment of a GAS infection include but are not limited to penicillin or a derivative thereof or clindamycin, cephalosporins, glycopeptides (e.g., vancomycin), and cycloserine.

The amount of active agent in a composition varies, however, depending upon the health and physical condition of the individual to be treated, age, the taxonomic group of individual to be treated (e.g., non-human primate, primate, etc.), the capacity of the individual's immune system to synthesize antibodies, the degree of protection desired, the formulation of the vaccine, the treating doctor's assessment of the medical situation, and other relevant factors. The amount will fall in a relatively broad range which can be determined through routine trials.

Kits

The invention also provides kits comprising one or more containers of compositions of the invention. Compositions can be in liquid form or can be lyophilized, as can individual antigens. Suitable containers for the compositions include, for example, bottles, vials, syringes, and test tubes. Containers can be formed from a variety of materials, including glass or plastic. A container may have a sterile access port (for example, the container may be an intravenous solution bag or a vial having a stopper pierceable by a hypodermic injection needle).

The kit can further comprise a second container comprising a pharmaceutically-acceptable buffer, such as phosphate-buffered saline, Ringer's solution, or dextrose solution. It can also contain other materials useful to the end-user, including other buffers, diluents, filters, needles, and syringes. The kit can also comprise a second or third container with another active agent, for example an antibiotic.

The kit can also comprise a package insert containing written instructions for methods of inducing immunity against S. pyogenes or for treating S. pyogenes infections. The package insert can be an unapproved draft package insert or can be a package insert approved by the Food and Drug Administration (FDA) or other regulatory body.

All patents, patent applications, and references cited in this disclosure are expressly incorporated herein by reference. The above disclosure generally describes the present invention. A more complete understanding can be obtained by reference to the following specific examples, which are provided for purposes of illustration only and are not intended to limit the scope of the invention.

EXAMPLE 1

Purified Wild-Type Recombinant GAS57 Cleaves IL-8 and Other CXC Cytokines

Wild-type GAS57 was expressed and purified from *E. coli* either as His-tagged or untagged protein. All variants were expressed without the N-terminal leader sequence and without the C-terminal transmembrane domain (see SEQ ID NOS:78 and 79). In detail, the gas57 gene was PCR amplified from M1_SF370 genome using the following primers:

```
                                         (SEQ ID NO: 69)
57F,       GTGCGT CATATG GCAGATGAGCTAAGCA (SEQ ID NO: 70)
57R,       GCGT CTCGAG GGCTTTTGCTGTTGCTGAGGT (SEQ ID NO: 71)
57stopR,   GCGT CTCGAG TTAGGCTTTTGCTGTTGCTGAGGT.
```

Primers 57F and 57R were used to obtain the His-tagged form, while primers 57F and 57stopR were used to obtain the untagged form. The PCR products were digested with NdeI-XhoI and ligated respectively with pET21b+ and pet24b+ cut with the same enzymes.

*E. coli* BL21(DE3) electrocompetent cells were transformed with the ligation reactions. Kanamycin resistant colonies carrying the plasmid with the correct insert (pET21_57his and pET24_57) were identified by colony PCR, and the GAS57 gene was sequenced from one of the positive clones.

Figure 7:
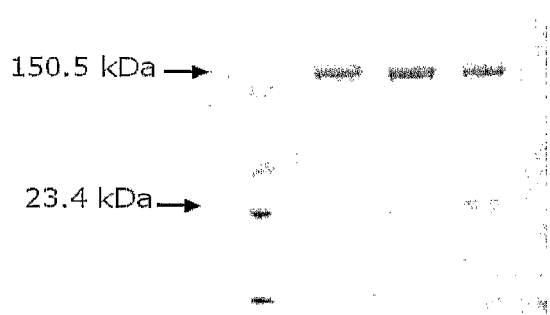
FIG. 7. Photomicrograph of an SDS-polyacrylamide gel demonstrating that wild-type GAS57 is post-translationally modified into two polypeptide fragments of 150.5 kDa and 23.4 kDa.
Figure 8:
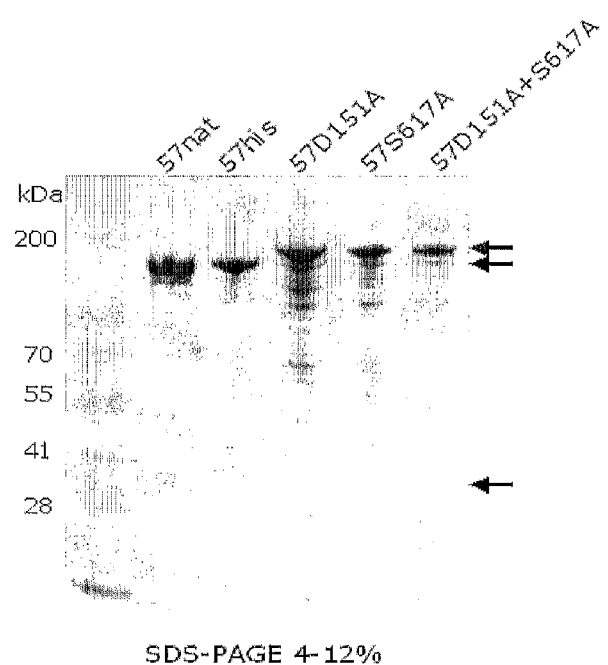
FIG. 8. Photomicrograph of an SDS-polyacrylamide gel demonstrating that GAS57 mutants D151A, S617A, and D151A+S617A are not post-translationally modified into two polypeptide fragments of 150.5 kDa and 23.4 kDa compared to wild-type (black arrows). A major band of 174 kDa corresponding to unprocessed protein is instead present in the lanes corresponding to inactive mutant strains (grey arrow).

The positive clone expressing GAS57 was grown in liquid culture at 25° C. under agitation, and the expression of the recombinant proteins was obtained by adding to the culture 1 mM IPTG. Purification of the His-tagged GAS57 protein was carried out using metal ion affinity chromatography (IMAC). Purification of the untagged form of GAS57 was accomplished using three chromatographic steps: ion exchange chromatography (Q SEPHAROSE HP), hydroxylapatite chromatography and gel filtration chromatography. FIGS. 7 and 8 show SDS-PAGE analyses of purified wild-type proteins.

In order to test GAS57 proteolytic activity, IL-8 was incubated with two different concentrations of purified GAS57 for increasing times and run on an SDS-polyacrylamide gel to demonstrate the conversion of the original 8 kDa IL-8 protein into the cleaved inactive 6 kDa protein. The results are shown in FIG. 1.

Figure 12:
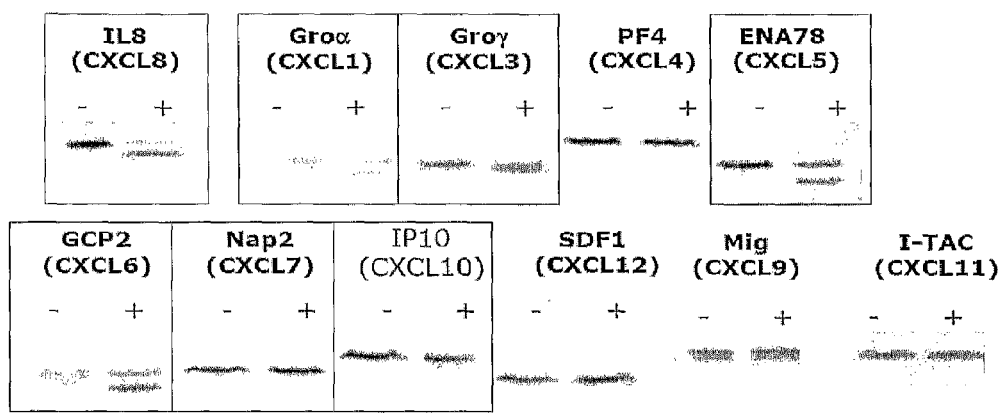
FIG. 12. Photomicrograph of SDS-polyacrylamide gels demonstrating cleavage of CXC chemokines by GAS57.

FIG. 12 shows the results of similar experiments in which various chemokines (10 μg/ml) were incubated with or without GAS57 (1 μg/ml) at 37° C. for 24 hours. Samples were than run on 18% SDS-polyacrylamide gel.

EXAMPLE 2

Preparation of GAS57 Mutants

By comparison with C5a protease (FIG. 2), three amino acids in the GAS57 were identified that putatively constitute the catalytic site of the protease: D151, H279 and S617. In order to obtain an inactive form of the enzyme, nucleotide substitutions resulting in amino acid changes D151A and/or S617A were introduced in the GAS57 coding sequence by Splicing by Overlapping Extension PCR (SOE-PCR).

Substitution D151A

Three PCR reactions were carried out:

| PCR reaction | Template | Primers |
|---|---|---|
| PCR1 (360 bps) | genomic SF370 | 57F, GTGCGTCATATGGCAGATGAG CTAAGCA; SEQ ID NO: 69<br>57mutDR1, CCCTGTGGCAATAACTG CGAC; SEQ ID NO: 72 |
| PCR2 (910 bp) | genomic SF370 | 57mutDF1, cgCAGTTATTGcCACAGGGAT, SEQ ID NO: 73<br>57mutSalR, CTGACTGAGTCGACAGACT CTGAATAGATG, SEQ ID NO: 74 |
| PCR3 (1270 bps) | PCR1, PCR2 | 57F<br>57mutSalR |

PCR product 3 was then digested with Nde-Sal and introduced in pET21_57his digested with the same enzymes. Clones containing the correct in-frame substitutions (pET21_57his_D151A) were selected by DNA sequencing.

Substitution S617A

Three PCR reactions were carried out:

| PCR reaction | Template | Primers |
|---|---|---|
| PCR4 (517 bp) | genomic SF370 | 57mutSalF, CTGACTGAGTCGACTTTAAAGACATAAAA GATAG; SEQ ID NO: 75<br>57mutSR1, GAGAGGCCATAGCTGTTCCTG; SEQ ID NO: 76 |
| PCR6 (4740 bp) | genomic SF370 | 57mutSF1, GGAACAGCTATGGCCTCTCCT; SEQ ID NO: 77<br>57R |

-continued

| PCR reaction | Template | Primers |
|---|---|---|
| PCR6 (5257 bp) | PCR4, PCR5 | 57FmutSalF 57R |

PCR product 6 was then digested with Sal-Xho and introduced in pET21_57his digested with the same enzymes. Clones containing the correct in-frame substitutions (pET21_57his_S617A) were selected by DNA sequencing.

Substitution D151A+S617A

PCR product 6 was digested Sal-Xho and introduced in pET21_57his_D151A digested with the same enzymes. Clones containing the correct in-frame substitutions (pET21_57his_D151A+S617A) were selected by DNA sequencing.

The single and double mutant proteins were expressed and purified as described above for wild-type GAS57 in Example 1.

EXAMPLE 3

Point Mutation D151A Results in Inactivation of GAS57 Proteolytic Activity

GAS57 mutant D151A was expressed as a recombinant His-tagged protein. Two types of assays demonstrated that this mutant has lost the ability to cleave IL-8.

SDS-PAGE

Figure 3:
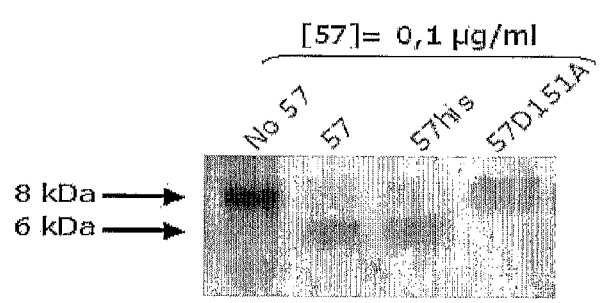
FIG. 3. Photomicrograph of SDS-polyacrylamide gels demonstrating that GAS57 point mutant D151A has lost the ability to cleave IL-8.

IL-8 was incubated with wild-type GAS57 or the GAS57 mutant D151A. The incubation mixtures were loaded on SDS-PAGE and revealed by silver staining. The results are shown in FIG. 3. Wild-type GAS57 (lanes 2 and 3) released two bands: 8 kDa (active form) and 6 kDa (inactive cleaved IL-8). In contrast, the GAS57 D151A mutant released only one band, which corresponded to uncleaved IL-8, as in the control reaction (without enzyme).

ELISA

IL-8 was incubated with wild-type GAS57 or the GAS57 mutant D151A at three different concentrations, and the incubation mixtures were tested for the presence of uncleaved IL-8 using an antibody which is specific for the cytokine but which is unable to recognize the cleaved inactive form. The results are shown in FIG. 4, expressed as percentage of uncleaved IL-8 after 0, 8 and 24 h reactions, and were calculated as follows:

$$\frac{[IL\text{-}8 \text{ in the reaction mix}]}{[IL\text{-}8 \text{ in the control mix}]} \times 100,$$

where "control mix" is the reaction mix without the enzyme at time point 0.

Figure 4:
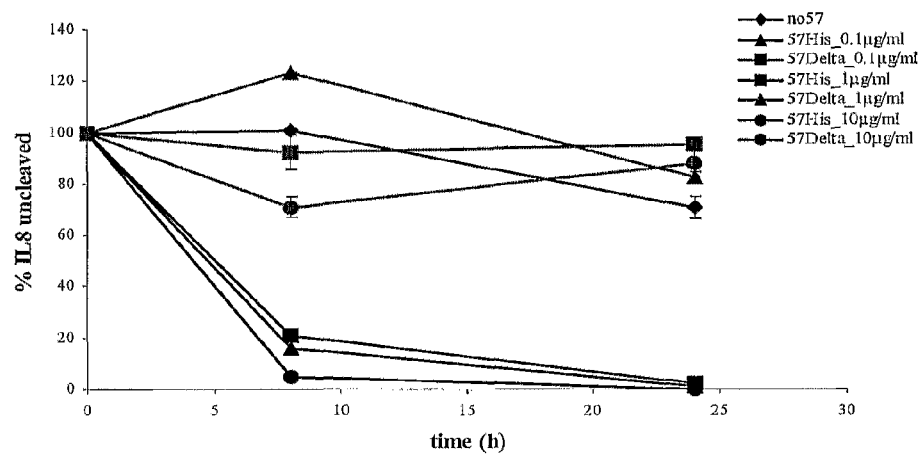
FIG. 4. Graph showing the results of an ELISA assay demonstrating that GAS57 point mutant D151A has lost the ability to cleave IL-8.

As shown in FIG. 4, wild-type GAS57 almost completely inactivated IL-8 after 8 hours, even at the lower concentration, while no inactivation was observed for IL-8 treated with the mutant enzyme.

EXAMPLE 4

GAS57 Mutant S617A and GAS57 Double Mutant D151A+S617A Do Not Cleave IL-8

GAS57 mutant S617A and GAS57 double mutant D151A+S617A were expressed as His-tagged proteins and were tested in IL-8 inactivation experiments as described in Example 2.

SDS-PAGE

IL-8 was incubated with either wild-type GAS57 (His-tagged or tag-less), or each of the GAS57 mutants D151A, S617A and D151AS+S617A for 24 hours. The incubation mixtures were loaded on an SDS-polyacrylamide gel and revealed by silver staining. The results of two experiments are shown in FIGS. 5A and 5B. Both the GAS57 S617A mutant and the GAS D151+S617A mutant are unable to cleave IL-8, even at a 100-fold higher concentration than wild-type GAS57.

ELISA

Figure 6:
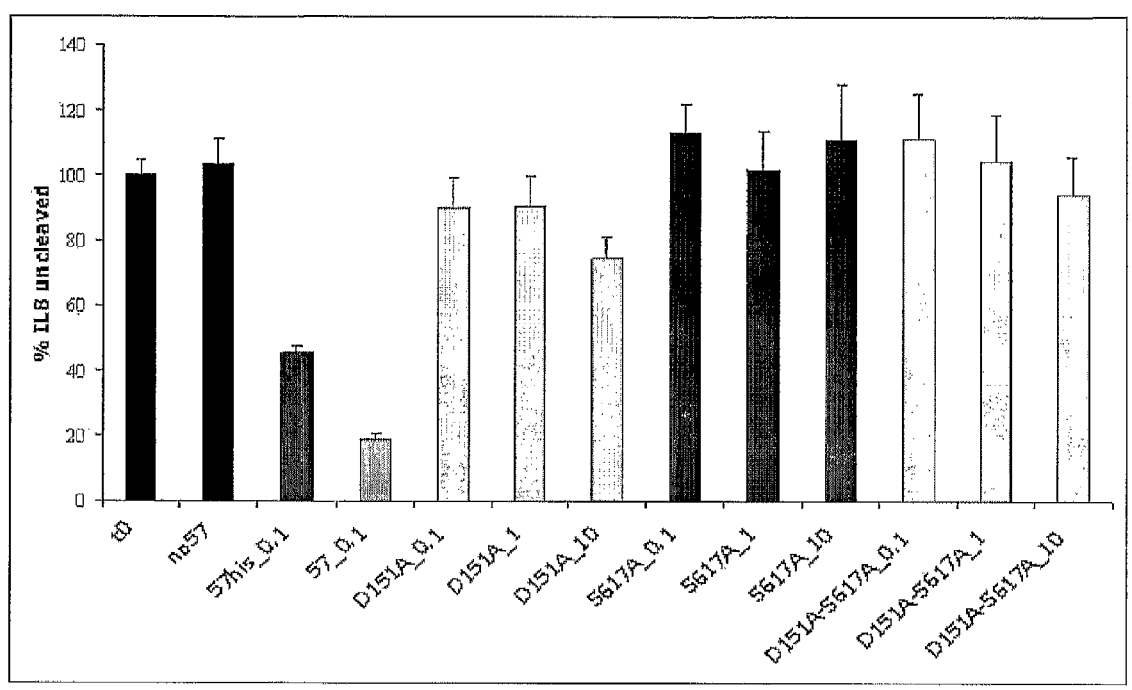
FIG. 6. Graph showing the results of an ELISA assay demonstrating that single mutants D151A and S617A and GAS57 double mutant D151A+S617A have lost GAS57 proteolytic activity.

The same samples were used to perform an ELISA assay which confirmed that the single and double amino acid substitutions eliminate the ability of GAS57 to cleave IL-8. The results, which are shown in FIG. 6, demonstrate that the mutants release 100% of uncleaved IL-8 after 24 h incubation, compared to 20-40% released by wild-type GAS57.

EXAMPLE 5

The Protective Capacity of GAS57 Mutants is Similar to that Obtained With Wild-Type GAS57

The GAS57 mutants D151A and D151A+S617A were used to immunize mice to test their capacity to confer protection against GAS lethal challenge in comparison to wild-type GAS57. The results of two experiments (20 mice each) are summarized below and expressed as average % survival.

| | NO. MICE | NO. DEAD | % SURVIVAL |
|---|---|---|---|
| PBS + Freund | 40 | 26 | 35 |
| 192 M1 + Freund | 20 | 0 | 100 |
| 57 WT + Freund | 40 | 12 | 70 |
| 57 D151A + Freund | 40 | 6 | 85 |
| 57 D151A-S617A + Freund | 40 | 9 | 78 |

EXAMPLE 6

Purified Inactive Mutants Appear as a Single Peptide Compared to Wild-Type GAS57, Which Exists Only in the Form of Two Non Covalently Associated Protein Fragments Wild-type GAS57 is obtained mainly in the form of two fragments, one of about 23 kDa and a one of 150 kDa. The two fragments are not separated in Ni-chelating affinity purification or by gel filtration, but appear as two different bands on SDS-PAGE (FIG. 7). N-terminal sequencing confirmed that the 23 kDa fragment is the N-terminal portion of GAS57 (amino acids 34-244 of SEQ ID NO:1) while the 150 kDa fragment is the C-terminal region (amino acids 245-1603 of SEQ ID NO:1).

In contrast to wild-type GAS57, GAS57 mutants of the invention are obtained as proteins of higher molecular weight (174 kDa), and the 23 kDa band is absent (see FIG. 8, which shows the results of an experiment in which partially purified wild-type GAS57 and GAS57 mutants were loaded on SDS-polyacrylamide gels).

EXAMPLE 7

Dose-Dependent Inhibition of GAS57-Mediated IL-8 Cleavage by Polyclonal Antisera Mouse antisera specific for GAS57, wild type and inactive mutants, were produced by immunizing CD1 mice with the purified recombinant proteins.

Figure 9:
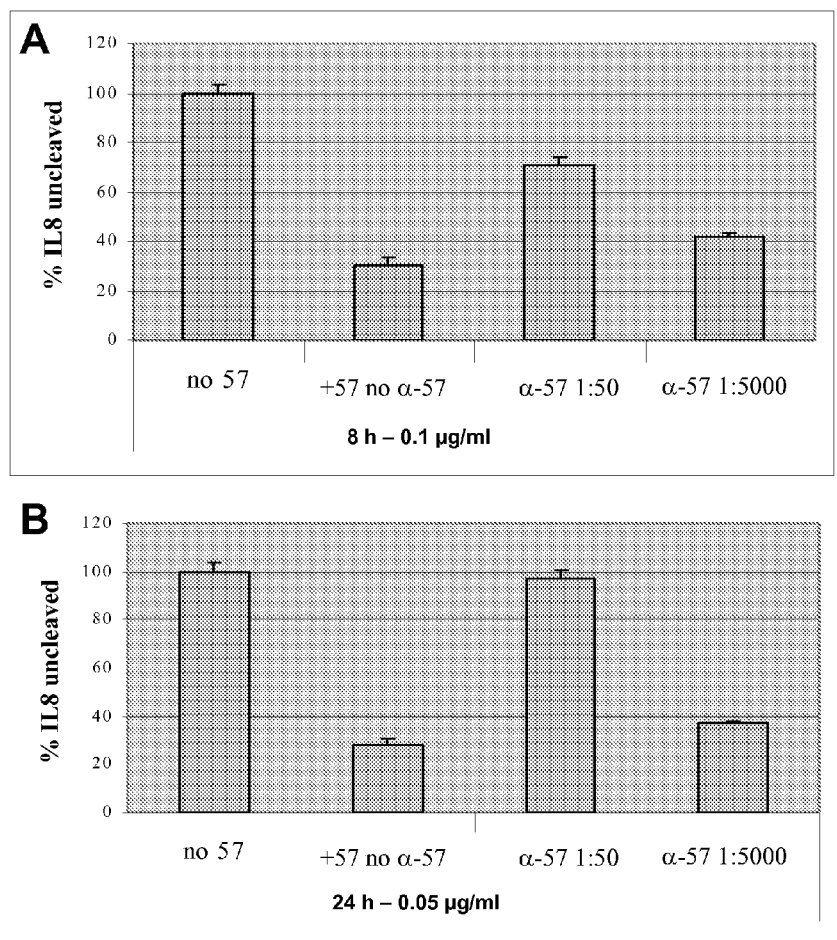
FIGS. 9A-B. ELISA assay results demonstrating dose-dependent inhibition of GAS57-mediated IL-8 cleavage by polyclonal antisera against GAS57 in two different experimental conditions.

IL-8 (10 µg/ml) was incubated with wild-type GAS57 with or without GAS57 antiserum (1:50 and 1:5000) in two different conditions: (1) 8 hour incubation, 0.1 µg/ml of GAS57 and (2) 24 hour incubation, 0.05 µg/ml of GAS57. The incubation mixtures were then tested for the presence of uncleaved IL-8 by ELISA. The results shown in FIGS. 9A and 9B demonstrated a dose-dependent inhibition of GAS57-mediated IL-8 cleavage by the mouse antiserum.

SEQUENCE LISTING (85 sequences)

SEQ ID NO: 1 - protein, 1647 aa, Streptococcus pyogenes
MEKKQRFSLRKYKSGTFSVLIGSVFLVMTTTVAADELSTMSEPTITNHAQQQAQHLTNTELSSAESKSQDTSQITLKTNREKEQSQDLVSEPTTTELADTDAASMANTGSDATQKSASLPPVNTDVHDWVKTKGAWDKGYKGQGKVVAVIDTGIDPAHQSMRISDVSTAKVKSKEDMLARQKAAGINYGSWINDKVVFAHNYVENSDNIKENQFEDFDEDWENFEFDAEAEPKAIKKHKIYRPQSTQAPKETVIKTEETDGSHDIDWTQTDDDTKYESHGMHVTGIVAGNSKEAAATGERFLGIAPEAQVMFMRVFANDIMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKDIKDSLGYDKSHQFAYVKESTDAGYNAQDVKGKIALIERDPNKTYDEMIALAKKHGALGVLIFNNKPGQSNRSMRLTANGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKDKTLRYDTELLTDHVDPQKGRFTLTSHSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGHYHYVVSYYPDVVGAKRQEMTFDMILDRQKPVLSQATFDPETNRFKPEPLKDRGLAGVRKDSVFYLERKDNKPYTVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASVSAIESTAWYGITARGSKVMPGDYQYVVTYRDEHGKEHQKQYTISVNDKKPMITQGRFDTINGVDHFTPDKTKALDSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKITMLATSQITAHFDHLLPEGSRVSLKTAQDQLIPLEQSLYVPKAYGKTVQEGTYEVVVSLPKGYRIEGNTKVNTLPNEVHELSLRLVKVGDASDSTGDHKVMSKNNSQALTASATPTKSTTSATAKALPSTGEKMGLKLRIVGLVLLGLTCVFSRKKSTKD

SEQ ID NO: 2 - protein, 1580 aa, Artificial Sequence
  GAS57 mutant D151A
ADELSTMSEPTITNHAQQQAQHLTNTELSSAESKSQDTSQITLKTNREKEQSQDLVSEPTTTELADTDAASMANTGSDATQKSASLPPVNTDVHDWVKTKGAWDKGYKGQGKVVAVIATGIDPAHQSMRISDVSTAKVKSKEDMLARQKAAGINYGSWINDKVVFAHNYVENSDNIKENQFEDFDEDWENFEFDAEAEPKAIKKHKIYRPQSTQAPKETVIKTEETDGSHDIDWTQTDDDTKYESHGMHVTGIVAGNSKEAAATGERFLGIAPEAQVMFMRVFANDIMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKDIKDSLGYDKSHQFAYVKESTDAGYNAQDVKGKIALIERDPNKTYDEMIALAKKHGALGVLIFNNKPGQSNRSMRLTANGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKDKTLRYDTELLTDHVDPQKGRFTLTSHSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGHYHYVVSYYPDVVGAKRQEMTFDMILDRQKPVLSQATFDPETNRFKPEPLKDRGLAGVRKDSVFYLERKDNKPYTVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASVSAIESTAWYGITARGSKVMPGDYQYVVTYRDEHGKEHQKQYTISVNDKKPMITQGRFDTINGVDHFTPDKTKALDSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKITMLATSQITAHFDHLLPEGSRVSLKTAQDQLIPLEQSLYVPKAYGKTVQEGTYEVVVSLPKGYRIEGNTKVNTLPNEVHELSLRLVKVGDASDSTGDHKVMSKNNSQALTASATPTKSTTSATAKA

SEQ ID NO: 3 - protein, 1580 aa, Artificial Sequence
  GAS57 mutant S617A
ADELSTMSEPTITNHAQQQAQHLTNTELSSAESKSQDTSQITLKTNREKEQSQDLVSEPTTTELADTDAASMANTGSDATQKSASLPPVNTDVHDWVKTKGAWDKGYKGQGKVVAVIDTGIDPAHQSMRISDVSTAKVKSKEDMLARQKAAGINYGSWINDKVVFAHNYVENSDNIKENQFEDFDEDWENFEFDAEAEPKAIKKHKIYRPQSTQAPKETVIKTEETDGSHDIDWTQTDDDTKYESHGMHVTGIVAGNSKEAAATGERFLGIAPEAQVMFMRVFANDIMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKDIKDSLGYDKSHQFAYVKESTDAGYNAQDVKGKIALIERDPNKTYDEMIALAKKHGALGVLIFNNKPGQSNRSMRLTANGMGIPSAFISHEFGKAMSQLNGNGTGSLEFDSVVSKAPSQKGNEMNHFSNWGLTSDGYLKPDITAPGGDIYSTYNDNHYGSQTGTAMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKDKTLRYDTELLTDHVDPQKGRFTLTSHSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGHYHYVVSYYPDVVGAKRQEMTFDMILDRQKPVLSQATFDPETNRFKPEPLKDRGLAGVRKDSVFYLERKDNKPYTVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASVSAIESTAWYGITARGSKVMPGDYQYVVTYRDEHGKEHQKQYTISVNDKKPMITQGRFDTINGVDHFTPDKTKALDSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKITMLATSQITAHFDHLLPEGSRVSLKTAQDQLIPLEQSLYVPKAYGKTVQEGTYEVVVSLPKGYRIEGNTKVNTLPNEVHELSLRLVKVGDASDSTGDHKVMSKNNSQALTASATPTKSTTSATAKA

SEQ ID NO: 4 - protein, 1580 aa, Artificial Sequence
  GAS57 mutant D151A + S617A
ADELSTMSEPTITNHAQQQAQHLTNTELSSAESKSQDTSQITLKTNREKEQSQDLVSEPTTTELADTDAASMANTGSDATQKSASLPPVNTDVHDWVKTKGAWDKGYKGQGKVVAVIATGIDPAHQSMRISDVSTAKVKSKEDMLARQKAAGINYGSWINDKVVFAHNYVENSDNIKENQFEDFDEDWENFEFDAEAEPKAIKKHKIYRPQSTQAPKETVIKTEETDGSHDIDWTQTDDDTKYESHGMHVTGIVAGNSKEAAATGERFLGIAPEAQVMFMRVFANDIMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKDIKDSLGYDKSHQFAYVKESTDAGYNAQDVKGKIALIERDPNKTYDEMIALAKKHGALGVLIFNNKPGQSNRSMRLTANGMGIPSAFISHEFGKAMSQLNGNGTGSLEFDSVVSKAPSQKGNEMNHFSNWGLTSDGYLKPDITAPGGDIYSTYNDNHYGSQTGTAMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKDKTLRYDTELLTDHVDPQKGRFTLTSHSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGHYHYVVSYYPDVVGAKRQEMTFDMILDRQKPVLSQATFDPETNRFKPEPLKDRGLAGVRKDSVFYLERKDNKPYTVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASVSAIESTAWYGITARGSKVMPGDYQYVVTYRDEHGKEHQKQYTISVNDKKPMITQGRFDTINGVDHFTPDKTKALDSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKITMLATSQITAHFDHLLPEGSRVSLKTAQDQLIPLEQSLYVPKAYGKTVQEGTYEVVVSLPKGYRIEGNTKVNTLPNEVHELSLRLVKVGDASDSTGDHKVMSKNNSQALTASATPTKSTTSATAKA

SEQ ID NO: 5 - DNA, 4944 bp, Streptococcus pyogenes
gtggagaaaaagcaacgtttttcccttagaaaatacaaatcaggaacgttttcggtcttaataggaagcgttttcttggtgatgacaacaacagtagcagcagatgagctaagcacaatgagcgaaccaacaatcacgaatcacgctcaacaacaagcgcaacatctcaccaatacagagttgagctcagctgaatcaaaatctcaagacacatcacaaatcactctcaagacaaatcgtgaaaaagagcaatcacaagatctagtctctgagccaaccacaactgagctagctgacacagatgcagcatcaatggctaatacaggttctgatgcgactcaaaaaagcgcttctttaccgccagtcaatacagatgttcacgattgggtaaaaaccaaaggagcttgggacaagggatacaaaggacaaggcaaggttgtcgcagttattgacacagggatcgatccggcccatcaaagcatgcgcatcagtgatgtatcaactgctaaagtaaaatcaaaagaagacatgctagcacgccaaaaagccgccggtattaattatgggagttggataaatgataaagttgtttttgcacataattatgtggaaaatagcgataatatcaaagaaaatcaattcgaggattttgatgaggactgggaaaactttgagtttgatgcagaggcagagccaaaagccatcaaaaaacacaagatctatcgtccccaatcaacccaggcaccgaaagaaactgttatcaaaacagaagaaacagatggttcacatgatattgactggacacaaacagacgatgacaccaaatacgagtcacacggtatgcatgtgacaggtattgtagccggtaatagcaaagaagccgctgctactggagaacgctttttaggaattgcaccagaggcccaagtcatgttcatgcgtgtttttgccaacgacatcatgggatcagctgaatcactctttatcaaagctatcgaagatgccgtggctttaggagcagatgtgatcaacctgagtcttggaaccgctaatggggcacagcttagtggcagcaagcctctaatggaagcaattgaaaaagctaaaaaagccggtgtatcagttgttgtagcagcaggaaatgagcgcgtctatggatctgaccatgatgatccattggcgacaaatccagactatggtttggtcggttctccctcaacaggtcgaacaccaacatcagtggcagctataaacagtaagtgggtgattcaacgtctaatgacggtcaaagaattagaaaaccgtgccgatttaaaccatggtaaagccatctattcagagtctgtcgactttaaagacataaaagatagcctaggttatgataaatcgcatcaatttgcttatgtcaaagagtcaactgatgcgggttataacgcacaagacgttaaaggtaaaattgctttaattgaacgtgatcccaataaaacctatgacgaaatgattgctttggctaagaaacatggagctctgggagtacttatttttaataacaagcctggtcaatcaaaccgctcaatgcgtctaacagctaatgggatggggataccatctgctttcatatcgcacgaatttggtaaggccatgtcccaattaaatggcaatggtacaggaagtttagagtttgacagtgtggtctcaaaagcaccgagtcaaaaaggcaatgaaatgaatcatttttcaaattggggcctaacttctgatggctatttaaaacctgacattactgcaccaggtggcgatatctattctacctataacgataaccactatggtagccaaacaggaacaagtatggcctctcctcagattgctggcgccagccttttggtcaaacaatacctagaaaagactcagccaaacttgccaaaagaaaaaattgctgatatcgttaagaacctattgatgagcaatgctcaaattcatgttaatccagagacaaaaacgaccacctcaccgcgtcagcaaggggcaggattacttaatattgacggagctgtcactagcggcctttatgtgacaggaaaagacaactatggcagtatatcattaggcaacatcacagatacgatgacgtttgatgtgactgttcacaacctaagcaataaagacaaaacattacgttatgacacagaattgctaacagatcatgtagacccacaaaagggccgcttcactttgacttctcactccttaaaaacgtaccaaggaggagaagttacagtcccagccaatggaaaagtgactgtaagggttaccatggatgtctcacagttcacaaaagagctaacaaaacagatgccaaatggttactatctagaaggttttgtccgctttagagatagtcaagatgaccaactaaatagagtaaacattccttttgttggttttaaagggcaatttgaaaacttagcagttgcagaagagtccatttacagattaaaatctcaaggcaaaactggtttttactttgatgaatcaggtccaaaagacgatatctatgtcggtaaacactttacaggacttgtcactcttggttcagagaccaatgtgtcaaccaaaacgatttctgacaatggtctacacacacttggcacctttaaaaatgcagatggcaaatttatcttagaaaaaaatgcccaaggaaaccctgtcttagccatttctccaaatggtgacaacaaccaagattttgcagccttcaaaggtgttttcttgagaaaatatcaaggcttaaaagcaagtgtctaccatgctagtgacaaggaacacaaaaatccactgtgggtcagcccagaaagctttaaaggagataaaaactttaatagtgacattagatttgcaaaatcaacgaccctgttaggcacagcattttctggaaaatcgttaacaggagctgaattaccagatgggcattatcattatgtggtgtcttattacccagatgtggtcggtgccaaacgtcaagaaatgacatttgacatgattttagaccgacaaaaaccggtactatcacaagcaacatttgatcctgaaacaaaccgattcaaaccagaacccctaaaagaccgtggattagctggtgttcgcaaagacagtgtcttttatctagaaagaaaagacaacaagccttatacagttacgataaacgatagctacaaatatgtctcagtagaagacaataaaacatttgtggagcgacaagctgatggcagctttatcttgccgcttgataaagcaaaattaggggatttctattacatggtcgaggattttgcagggaacgtggccatcgctaagttaggagatcacttaccacaaacattaggtaaaacaccaattaaacttaagcttacagacggtaattatcagaccaaagaaacgcttaaagataatcttgaaatgacacagtctgacacaggtctagtcacaaatcaagcccagctagcagtggtgcaccgcaatcagccgcaaagccagctaacaaagatgaatcaggatttctttatctcaccaaacgaagatgggaataaagactttgtggcctttaaaggcttgaaaaataacgtgtataatgacttaacggttaacgtatacgctaaagatgaccaccaaaaacaaacccctatctggtctagtcaagcaggcgctagtgtatccgctattgaaagtacagcctggtatggcataacagcccgaggaagcaaggtgatgccaggtgattatcagtatgttgtgacctatcgtgacgaacatggtaaagaacatcaaaagcagtacaccatatctgtgaatgacaaaaaaccaatgatcactcagggacgttttgataccattaatggcgttgaccactttactcctgacaagacaaaagcccttgactcatcaggcattgtccgcgaagaagtcttttacttggccaagaaaaatggccgtaaatttgatgtgacagaaggtaaagatggtatcacagttagtgacaataaggtgtatatccctaaaaatccagatggttcttacaccatttcaaaaagagatggtgtcacactgtcagattattactaccttgtcgaagatagagctggtaatgtgtcttttgctaccttgcgtgacctaaaagcggtcggaaaagacaaagcagtagtcaattttggattagacttaccggtccctgaagacaaacaaatagtgaactttacctaccttgtgcgggatgcagatggtaaaccgattgaaaacctagagtattataataactcaggtaacagtcttatcttgccatacggcaaatacacggtcgaattgttgacctatgacaccaatgcagccaaactagagtcagataaaatcgtttcctttaccttgtcagctgataacaacttccaacaagttacctttaagataacgatgttagcaacttctcaaataactgcccactttgatcatcttttgccagaaggcagtcgcgttagccttaaaacagctcaagatcagctaatcccgcttgaacagtccttgtatgtgcctaaagcttatggcaaaaccgttcaagaaggcacttacgaagttgttgtcagcctgcctaaaggctaccgtatcgaaggcaacacaaaggtgaataccctaccaaatgaagtgcacgaactatcattacgccttgtcaaagtaggagatgcctcagattcaactggtgatcataaggttatgtcaaaaaataattcacaggctttgacagcctctgccacaccaaccaagtcaacgacctcagcaacagcaaaagccctaccatcaacgggtgaaaaaatgggtctcaagttgcgcatagtaggtcttgtgttactcggacttacttgcgtctttagccgaaaaaaatcaaccaaagattga

SEQ ID NO: 6 - DNA, 4740 bp, Artificial Sequence
  GAS57 mutant D151A
gcagatgagctaagcacaatgagcgaaccaacaatcacgaatcacgctcaacaacaagcgcaacatctcaccaatacagagttgagctcagctgaatcaaaatctcaagacacatcacaaatcactctcaagacaaatcgtgaaaaagagcaatcacaagatctagtctctgagccaaccacaactgagctagctgacacagatgcagcatcaatggctaatacaggttctgatgcgactcaaaaaagcgcttctttaccgccagtcaatacagatgttcacgattgggtaaaaaccaaaggagcttgggacaagggatacaaaggacaaggcaaggttgtcgcagttattgccacagggatcgatccggcccatcaaagcatgcgcatcagtgatgtatcaactgctaaagtaaaatcaaaagaagacatgctagcacgccaaaaagccgccggtattaattatgggagttggataaatgataaagttgtttttgcacataattatgtggaaaatagcgataatatcaaagaaaatcaattcgaggattttgatgaggactgggaaaactttgagtttgatgcagaggcagagccaaaagccatcaaaaaacacaagatctatcgtccccaatcaacccaggcaccgaaagaaactgttatcaaaacagaagaaacagatggttcacatgatattgactggacacaaacagacgatgacaccaaatacgagtcacacggtatgcatgtgacaggtattgtagccggtaatagcaaagaagccgctgctactggagaacgctttttaggaattgcaccagaggcccaagtcatgttcatgcgtgtttttgccaacgacatcatgggatcagctgaatcactctttatcaaagctatcgaagatgccgtggctttaggagcagatgtgatcaacctgagtcttggaaccgctaatggggcacagcttagtggcagcaagcctctaatggaagcaattgaaaaagctaaaaaagccggtgtatcagttgttgtagcagcaggaaatgagcgcgtctatggatctgaccatgatgatccattggcgacaaatccagactatggtttggtcggttctccctcaacaggtcgaacaccaacatcagtggcagctataaacagtaagtgggtgattcaacgtctaatgacggtcaaagaattagaaaaccgtgccgatttaaaccatggtaaagccatctattcagagtctgtcgactttaaagacataaaagatagcctaggttatgataaatcgcatcaatttgcttatgtcaaagagtcaactgatgcgggttataacgcacaagacgttaaaggtaaaattgctttaattgaacgtgatcccaataaaacctatgacgaaatgattgctttggctaagaaacatggagctctgggagtacttatttttaataacaagcctggtcaatcaaaccgctcaatgcgtctaacagctaatgggatggggataccatctgctttcatatcgcacgaatttggtaaggccatgtcccaattaaatggcaatggtacaggaagtttagagtttgacagtgtggtctcaaaagcaccgagtcaaaaaggcaatgaaatgaatcatttttcaaattggggcctaacttctgatggctatttaaaacctgacattactgcaccaggtggcgatatctattctacctataacgataaccactatggtagccaaacaggaacaagtatggcctctcctcagattgctggcgccagccttttggtcaaacaatacctagaaaagactcagccaaacttgccaaaagaaaaaattgctgatatcgttaagaacctattgatgagcaatgctcaaattcatgttaatccagagacaaaaacgaccacctcaccgcgtcagcaaggggcaggattacttaatattgacggagctgtcactagcggcctttatgtgacaggaaaagacaactatggcagtatatcattaggcaacatcacagatacgatgacgtttgatgtgactgttcacaacctaagcaataaagacaaaacattacgttatgacacagaattgctaacagatcatgtagacccacaaaagggccgcttcactttgacttctcactccttaaaaacgtaccaaggaggagaagttacagtcccagccaatggaaaagtgactgtaagggttaccatggatgtctcacagttcacaaaagagctaacaaaacagatgccaaatggttactatctagaaggttttgtccgctttagagatagtcaagatgaccaactaaatagagtaaacattccttttgttggttttaaagggcaatttgaaaacttagcagttgcagaagagtccatttacagattaaaatctcaaggcaaaactggtttttactttgatgaatcaggtccaaaagacgatatctatgtcggtaaacactttacaggacttgtcactcttggttcagagaccaatgtgtcaaccaaaacgatttctgacaatggtctacacacacttggcacctttaaaaatgcagatggcaaatttatcttagaaaaaaatgcccaaggaaaccctgtcttagccatttctccaaatggtgacaacaaccaagattttgcagccttcaaaggtgttttcttgagaaaatatcaaggcttaaaagcaagtgtctaccatgctagtgacaaggaacacaaaaatccactgtgggtcagcccagaaagctttaaaggagataaaaactttaatagtgacattagatttgcaaaatcaacgaccctgttaggcacagcattttctggaaaatcgttaacaggagctgaattaccagatgggcattatcattatgtggtgtcttattacccagatgtggtcggtgccaaacgtcaagaaatgacatttgacatgattttagaccgacaaaaaccggtactatcacaagcaacatttgatcctgaaacaaaccgattcaaaccagaacccctaaaagaccgtggattagctggtgttcgcaaagacagtgtcttttatctagaaagaaaagacaacaagccttatacagttacgataaacgatagctacaaatatgtctcagtagaagacaataaaacatttgtggagcgacaagctgatggcagctttatcttgccgcttgataaagcaaaattaggggatttctattacatggtcgaggattttgcagggaacgtggccatcgctaagttaggagatcacttaccacaaacattaggtaaaacaccaattaaacttaagcttacagacggtaattatcagaccaaagaaacgcttaaagataatcttgaaatgacacagtctgacacaggtctagtcacaaatcaagcccagctagcagtggtgcaccgcaatcagccgcaaagccagctaacaaagatgaatcaggatttctttatctcaccaaacgaagatgggaataaagactttgtggcctttaaaggcttgaaaaataacgtgtataatgacttaacggttaacgtatacgctaaagatgaccaccaaaaacaaacccctatctggtctagtcaagcaggcgctagtgtatccgctattgaaagtacagcctggtatggcataacagcccgaggaagcaaggtgatgccaggtgattatcagtatgttgtgacctatcgtgacgaacatggtaaagaacatcaaaagcagtacaccatatctgtgaatgacaaaaaaccaatgatcactcagggacgttttgataccattaatggcgttgaccactttactcctgacaagacaaaagcccttgactcatcaggcattgtccgcgaagaagtcttttacttggccaagaaaaatggccgtaaatttgatgtgacagaaggtaaagatggtatcacagttagtgacaataaggtgtatatccctaaaaatccagatggttcttacaccatttcaaaaagagatggtgtcacactgtcagattattactaccttgtcgaagatagagctggtaatgtgtcttttgctaccttgcgtgacctaaaagcggtcggaaaagacaaagcagtagtcaattttggattagacttaccggtccctgaagacaaacaaatagtgaactttacctaccttgtgcgggatgcagatggtaaaccgattgaaaacctagagtattataataactcaggtaacagtcttatcttgccatacggcaaatacacggtcgaattgttgacctatgacaccaatgcagccaaactagagtcagataaaatcgtttcctttaccttgtcagctgataacaacttccaacaagttacctttaagataacgatgttagcaacttctcaaataactgcccactttgatcatcttttgccagaaggcagtcgcgttagccttaaaacagctcaagatcagctaatcccgcttgaacagtccttgtatgtgcctaaagcttatggcaaaaccgttcaagaaggcacttacgaagttgttgtcagcctgcctaaaggctaccgtatcgaaggcaacacaaaggtgaataccctaccaaatgaagtgcacgaactatcattacgccttgtcaaagtaggagatgcctcagattcaactggtgatcataaggttatgtcaaaaaataattcacaggctttgacagcctctgccacaccaaccaagtcaacgacctcagcaacagcaaaagcc

SEQ ID NO: 7 - DNA, 4740 bp, Artificial Sequence
  GAS57 mutant S617A
gcagatgagctaagcacaatgagcgaaccaacaatcacgaatcacgctcaacaacaagcgcaacatctcaccaatacagagttgagctcagctgaatcaaaatctcaagacacatcacaaatcactctcaagacaaatcgtgaaaaagagcaatcacaagatctagtctctgagccaaccacaactgagctagctgacacagatgcagcatcaatggctaatacaggttctgatgcgactcaaaaaagcgcttctttaccgccagtcaatacagatgttcacgattgggtaaaaaccaaaggagcttgggacaagggatacaaaggacaaggcaaggttgtcgcagttattgacacagggatcgatccggcccatcaaagcatgcgcatcagtgatgtatcaactgctaaagtaaaatcaaaagaagacatgctagcacgccaaaaagccgccggtattaattatgggagttggataaatgataaagttgtttttgcacataattatgtggaaaatagcgataatatcaaagaaaatcaattcgaggattttgatgaggactgggaaaactttgagtttgatgcagaggcagagccaaaagccatcaaaaaacacaagatctatcgtccccaatcaacccaggcaccgaaagaaactgttatcaaaacagaagaaacagatggttcacatgatattgactggacacaaacagacgatgacaccaaatacgagtcacacggtatgcatgtgacaggtattgtagccggtaatagcaaagaagccgctgctactggagaacgctttttaggaattgcaccagaggcccaagtcatgttcatgcgtgtttttgccaacgacatcatgggatcagctgaatcactctttatcaaagctatcgaagatgccgtggctttaggagcagatgtgatcaacctgagtcttggaaccgctaatggggcacagcttagtggcagcaagcctctaatggaagcaattgaaaaagctaaaaaagccggtgtatcagttgttgtagcagcaggaaatgagcgcgtctatggatctgaccatgatgatccattggcgacaaatccagactatggtttggtcggttctccctcaacaggtcgaacaccaacatcagtggcagctataaacagtaagtgggtgattcaacgtctaatgacggtcaaagaattagaaaaccgtgccgatttaaaccatggtaaagccatctattcagagtctgtcgactttaaagacataaaagatagcctaggttatgataaatcgcatcaatttgcttatgtcaaagagtcaactgatgcgggttataacgcacaagacgttaaaggtaaaattgctttaattgaacgtgatcccaataaaacctatgacgaaatgattgctttggctaagaaacatggagctctgggagtacttatttttaataacaagcctggtcaatcaaaccgctcaatgcgtctaacagctaatgggatggggataccatctgctttcatatcgcacgaatttggtaaggccatgtcccaattaaatggcaatggtacaggaagtttagagtttgacagtgtggtctcaaaagcaccgagtcaaaaaggcaatgaaatgaatcatttttcaaattggggcctaacttctgatggctatttaaaacctgacattactgcaccaggtggcgatatctattctacctataacgataaccactatggtagccaaacaggaacagctatggcctctcctcagattgctggcgccagccttttggtcaaacaatacctagaaaagactcagccaaacttgccaaaagaaaaaattgctgatatcgttaagaacctattgatgagcaatgctcaaattcatgttaatccagagacaaaaacgaccacctcaccgcgtcagcaaggggcaggattacttaatattgacggagctgtcactagcggcctttatgtgacaggaaaagacaactatggcagtatatcattaggcaacatcacagatacgatgacgtttgatgtgactgttcacaacctaagcaataaagacaaaacattacgttatgacacagaattgctaacagatcatgtagacccacaaaagggccgcttcactttgacttctcactccttaaaaacgtaccaaggaggagaagttacagtcccagccaatggaaaagtgactgtaagggttaccatggatgtctcacagttcacaaaagagctaacaaaacagatgccaaatggttactatctagaaggttttgtccgctttagagatagtcaagatgaccaactaaatagagtaaacattccttttgttggttttaaagggcaatttgaaaacttagcagttgcagaagagtccatttacagattaaaatctcaaggcaaaactggtttttactttgatgaatcaggtccaaaagacgatatctatgtcggtaaacactttacaggacttgtcactcttggttcagagaccaatgtgtcaaccaaaacgatttctgacaatggtctacacacacttggcacctttaaaaatgcagatggcaaatttatcttagaaaaaaatgcccaaggaaaccctgtcttagccatttctccaaatggtgacaacaaccaagattttgcagccttcaaaggtgttttcttgagaaaatatcaaggcttaaaagcaagtgtctaccatgctagtgacaaggaacacaaaaatccactgtgggtcagcccagaaagctttaaaggagataaaaactttaatagtgacattagatttgcaaaatcaacgaccctgttaggcacagcattttctggaaaatcgttaacaggagctgaattaccagatgggcattatcattatgtggtgtcttattacccagatgtggtcggtgccaaacgtcaagaaatgacatttgacatgattttagaccgacaaaaaccggtactatcacaagcaacatttgatcctgaaacaaaccgattcaaaccagaacccctaaaagaccgtggattagctggtgttcgcaaagacagtgtcttttatctagaaagaaaagacaacaagccttatacagttacgataaacgatagctacaaatatgtctcagtagaagacaataaaacatttgtggagcgacaagctgatggcagctttatcttgccgcttgataaagcaaaattaggggatttctattacatggtcgaggattttgcagggaacgtggccatcgctaagttaggagatcacttaccacaaacattaggtaaaacaccaattaaacttaagcttacagacggtaattatcagaccaaagaaacgcttaaagataatcttgaaatgacacagtctgacacaggtctagtcacaaatcaagcccagctagcagtggtgcaccgcaatcagccgcaaagccagctaacaaagatgaatcaggatttctttatctcaccaaacgaagatgggaataaagactttgtggcctttaaaggcttgaaaaataacgtgtataatgacttaacggttaacgtatacgctaaagatgaccaccaaaaacaaacccctatctggtctagtcaagcaggcgctagtgtatccgctattgaaagtacagcctggtatggcataacagcccgaggaagcaaggtgatgccaggtgattatcagtatgttgtgacctatcgtgacgaacatggtaaagaacatcaaaagcagtacaccatatctgtgaatgacaaaaaaccaatgatcactcagggacgttttgataccattaatggcgttgaccactttactcctgacaagacaaaagcccttgactcatcaggcattgtccgcgaagaagtcttttacttggccaagaaaaatggccgtaaatttgatgtgacagaaggtaaagatggtatcacagttagtgacaataaggtgtatatccctaaaaatccagatggttcttacaccatttcaaaaagagatggtgtcacactgtcagattattactaccttgtcgaagatagagctggtaatgtgtcttttgctaccttgcgtgacctaaaagcggtcggaaaagacaaagcagtagtcaattttggattagacttaccggtccctgaagacaaacaaatagtgaactttacctaccttgtgcgggatgcagatggtaaaccgattgaaaacctagagtattataataactcaggtaacagtcttatcttgccatacggcaaatacacggtcgaattgttgacctatgacaccaatgcagccaaactagagtcagataaaatcgtttcctttaccttgtcagctgataacaacttccaacaagttacctttaagataacgatgttagcaacttctcaaataactgcccactttgatcatcttttgccagaaggcagtcgcgttagccttaaaacagctcaagatcagctaatcccgcttgaacagtccttgtatgtgcctaaagcttatggcaaaaccgttcaagaaggcacttacgaagttgttgtcagcctgcctaaaggctaccgtatcgaaggcaacacaaaggtgaataccctaccaaatgaagtgcacgaactatcattacgccttgtcaaagtaggagatgcctcagattcaactggtgatcataaggttatgtcaaaaaataattcacaggctttgacagcctctgccacaccaaccaagtcaacgacctcagcaacagcaaaagcc

SEQ ID NO: 8 - DNA, 4740 bp, Artificial Sequence
  GAS57 mutant D151A + S617A
gcagatgagctaagcacaatgagcgaaccaacaatcacgaatcacgctcaacaacaagcgcaacatctcaccaatacagagttgagctcagctgaatcaaaatctcaagacacatcacaaatcactctcaagacaaatcgtgaaaaagagcaatcacaagatctagtctctgagccaaccacaactgagctagctgacacagatgcagcatcaatggctaatacaggttctgatgcgactcaaaaaagcgcttctttaccgccagtcaatacagatgttcacgattgggtaaaaaccaaaggagcttgggacaagggatacaaaggacaaggcaaggttgtcgcagttattgccacagggatcgatccggcccatcaaagcatgcgcatcagtgatgtatcaactgctaaagtaaaatcaaaagaagacatgctagcacgccaaaaagccgccggtattaattatgggagttggataaatgataaagttgtttttgcacataattatgtggaaaatagcgataatatcaaagaaaatcaattcgaggattttgatgaggactgggaaaactttgagtttgatgcagaggcagagccaaaagccatcaaaaaacacaagatctatcgtccccaatcaacccaggcaccgaaagaaactgttatcaaaacagaagaaacagatggttcacatgatattgactggacacaaacagacgatgacaccaaatacgagtcacacggtatgcatgtgacaggtattgtagccggtaatagcaaagaagccgctgctactggagaacgctttttaggaattgcaccagaggcccaagtcatgttcatgcgtgtttttgccaacgacatcatgggatcagctgaatcactctttatcaaagctatcgaagatgccgtggctttaggagcagatgtgatcaacctgagtcttggaaccgctaatggggcacagcttagtggcagcaagcctctaatggaagcaattgaaaaagctaaaaaagccggtgtatcagttgttgtagcagcaggaaatgagcgcgtctatggatctgaccatgatgatccattggcgacaaatccagactatggtttggtcggttctccctcaacaggtcgaacaccaacatcagtggcagctataaacagtaagtgggtgattcaacgtctaatgacggtcaaagaattagaaaaccgtgccgatttaaaccatggtaaagccatctattcagagtctgtcgactttaaagacataaaagatagcctaggttatgataaatcgcatcaatttgcttatgtcaaagagtcaactgatgcgggttataacgcacaagacgttaaaggtaaaattgctttaattgaacgtgatcccaataaaacctatgacgaaatgattgctttggctaagaaacatggagctctgggagtacttatttttaataacaagcctggtcaatcaaaccgctcaatgcgtctaacagctaatgggatggggataccatctgctttcatatcgcacgaatttggtaaggccatgtcccaattaaatggcaatggtacaggaagtttagagtttgacagtgtggtctcaaaagcaccgagtcaaaaaggcaatgaaatgaatcatttttcaaattggggcctaacttctgatggctatttaaaacctgacattactgcaccaggtggcgatatctattctacctataacgataaccactatggtagccaaacaggaacagctatggcctctcctcagattgctggcgccagccttttggtcaaacaatacctagaaaagactcagccaaacttgccaaaagaaaaaattgctgatatcgttaagaacctattgatgagcaatgctcaaattcatgttaatccagagacaaaaacgaccacctcaccgcgtcagcaaggggcaggattacttaatattgacggagctgtcactagcggcctttatgtgacaggaaaagacaactatggcagtatatcattaggcaacatcacagatacgatgacgtttgatgtgactgttcacaacctaagcaataaagacaaaacattacgttatgacacagaattgctaacagatcatgtagacccacaaaagggccgcttcactttgacttctcactccttaaaaacgtaccaaggaggagaagttacagtcccagccaatggaaaagtgactgtaagggttaccatggatgtctcacagttcacaaaagagctaacaaaacagatgccaaatggttactatctagaaggttttgtccgctttagagatagtcaagatgaccaactaaatagagtaaacattccttttgttggttttaaagggcaatttgaaaacttagcagttgcagaagagtccatttacagattaaaatctcaaggcaaaactggtttttactttgatgaatcaggtccaaaagacgatatctatgtcggtaaacactttacaggacttgtcactcttggttcagagaccaatgtgtcaaccaaaacgatttctgacaatggtctacacacacttggcacctttaaaaatgcagatggcaaatttatcttagaaaaaaatgcccaaggaaaccctgtcttagccatttctccaaatggtgacaacaaccaagattttgcagccttcaaaggtgttttcttgagaaaatatcaaggcttaaaagcaagtgtctaccatgctagtgacaaggaacacaaaaatccactgtgggtcagcccagaaagctttaaaggagataaaaactttaatagtgacattagatttgcaaaatcaacgaccctgttaggcacagcattttctggaaaatcgttaacaggagctgaattaccagatgggcattatcattatgtggtgtcttattacccagatgtggtcggtgccaaacgtcaagaaatgacatttgacatgattttagaccgacaaaaaccggtactatcacaagcaacatttgatcctgaaacaaaccgattcaaaccagaacccctaaaagaccgtggattagctggtgttcgcaaagacagtgtcttttatctagaaagaaaagacaacaagccttatacagttacgataaacgatagctacaaatatgtctcagtagaagacaataaaacatttgtggagcgacaagctgatggcagctttatcttgccgcttgataaagcaaaattaggggatttctattacatggtcgaggattttgcagggaacgtggccatcgctaagttaggagatcacttaccacaaacattaggtaaaacaccaattaaacttaagcttacagacggtaattatcagaccaaagaaacgcttaaagataatcttgaaatgacacagtctgacacaggtctagtcacaaatcaagcccagctagcagtggtgcaccgcaatcagccgcaaagccagctaacaaagatgaatcaggatttctttatctcaccaaacgaagatgggaataaagactttgtggcctttaaaggcttgaaaaataacgtgtataatgacttaacggttaacgtatacgctaaagatgaccaccaaaaacaaacccctatctggtctagtcaagcaggcgctagtgtatccgctattgaaagtacagcctggtatggcataacagcccgaggaagcaaggtgatgccaggtgattatcagtatgttgtgacctatcgtgacgaacatggtaaagaacatcaaaagcagtacaccatatctgtgaatgacaaaaaaccaatgatcactcagggacgttttgataccattaatggcgttgaccactttactcctgacaagacaaaagcccttgactcatcaggcattgtccgcgaagaagtcttttacttggccaagaaaaatggccgtaaatttgatgtgacagaaggtaaagatggtatcacagttagtgacaataaggtgtatatccctaaaaatccagatggttcttacaccatttcaaaaagagatggtgtcacactgtcagattattactaccttgtcgaagatagagctggtaatgtgtcttttgctaccttgcgtgacctaaaagcggtcggaaaagacaaagcagtagtcaattttggattagacttaccggtccctgaagacaaacaaatagtgaactttacctaccttgtgcgggatgcagatggtaaaccgattgaaaacctagagtattataataactcaggtaacagtcttatcttgccatacggcaaatacacggtcgaattgttgacctatgacaccaatgcagccaaactagagtcagataaaatcgtttcctttaccttgtcagctgataacaacttccaacaagttacctttaagataacgatgttagcaacttctcaaataactgcccactttgatcatcttttgccagaaggcagtcgcgttagccttaaaacagctcaagatcagctaatcccgcttgaacagtccttgtatgtgcctaaagcttatggcaaaaccgttcaagaaggcacttacgaagttgttgtcagcctgcctaaaggctaccgtatcgaaggcaacacaaaggtgaataccctaccaaatgaagtgcacgaactatcattacgccttgtcaaagtaggagatgcctcagattcaactggtgatcataaggttatgtcaaaaaataattcacaggctttgacagcctctgccacaccaaccaagtcaacgacctcagcaacagcaaaagcc

SEQ ID NO: 9 - protein, 1181 aa, Streptococcus pyogenes
MRKKQKLPFDKLAIALMSTSILLNAQSDIKANTVTEDTPATEQAVETPQPTAVSEEAPSSKETKTPQTPDDAEETIADDANDLAPQAPAKTADTPATSKATIRDLNDPSQVKTLQEKAGKGAGTVVAVIDAGFDKNHEAWRLTDKTKARYQSKEDLEKAKKEHGITYGEWVNDKVAYYHDYSKDGKTAVDQEHGTHVSGILSGNAPSETKEPYRLEGAMPEAQLLLMRVEIVNGLADYARNYAQAIIDAVNLGAKVINMSFGNAALAYANLPDETKKAFDYAKSKGVSIVTSAGNDSSFGGKTRLPLADHPDYGVVGTPAAADSTLTVASYSPDKQLTETATVKTADQQDKEMPVLSTNRFEPNKAYDYAYANRGMKEDDFKDVKGKIALIERGDIDFKDKIANAKKAGAVGVLIYDNQDKGFPIELPNVDQMPAAFISRKDGLLLKENPQKTITFNATPKVLPTASGTKLSRFSSWGLTADGNIKPDIAAPGQDILSSVANNKYAKLSGTSMSAPLVAGIMGLLQKQYETQYPDMTPSERLDLAKKVLMSSATALYDEDEKAYFSPRQQGAGAVDAKKASAATMYVTDKDNTSSKVHLNNVSDKFEVTVTVHNKSDKPQELYYQATVQTDKVDGKLFALAPKALYETSWQKITIPANSSKQVTIPIDVSQFSKDLLAPMKNGYFLEGFVRFKQDPTKEELMSIPYIGFRGDFGNLSALEKPIYDSKDGSSYYHEANSDAKDQLDGDGLQFYALKNNFTALTTESNPWTIIKAVKEGVENIEDIESSEITETIFAGTFAKQDDDSHYYIHRHANGKPYAAISPNGDGNRDYVQFQGTFLRNAKNLVAEVLDKEGNVVWTSEVTEQVVKNYNNDLASTLGSTRFEKTRWDGKDKDGKVVANGTYTYRVRYTPISSGAKEQHTDFDVIVDNTTPEVATSATFSTEDRRLTLASKPKTSQPVYRERIAYTYMDEDLPTTEYISPNEDGTFTLPEEAETMEGATVPLKMSDFTYVVEDMAGNITYTPVTKLLEGHSNKPEQDGSDQAPDKKPETKPEQDGSGQAPDKKPETKPEQDGSGQTPDKKPETKPEQDGSGQTPDKKPETKPEKDSSGQTPGKTPQKGQPSRTLEKRSSKRALATKASTKDQLPTTNDKDTNRLHLLKLVMTTFFLGLVAHIFKTKRTED

SEQ ID NO: 10 - protein, 1647 aa, Streptococcus pyogenes
VEKKQRFSLRKYKSGTFSVLIGSVFLVMTTTVAADELSTMSEPTITNHAQQQAQHLTNTELSSAESKSQDTSQITLKTNREKEQSQDLVSEPTTTELADTDAASMANTGSDATQKSASLPPVNTDVHDWVKTKGAWDKGYKGQGKVVAVIDTGIDPAHQSMRISDVSTAKVKSKEDMLARQKAAGINYGSWINDKVVFAHNYVENSDNIKENQFEDFDEDWENFEFDAEAEPKAIKKHKIYRPQSTQAPKETVIKTEETDGSHDIDWTQTDDDTKYESHGMHVTGIVAGNSKEAAATGERFLGIAPEAQVMFMRVFANDIMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKDIKDSLGYDKSHQFAYVKESTDAGYNAQDVKGKIALIERDPNKTYDEMIALAKKHGALGVLIFNNKPGQSNRSMRLTANGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKDKTLRYDTELLTDHVDPQKGRFTLTSHSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGHYHYVVSYYPDVVGAKRQEMTFDMILDRQKPVLSQATFDPETNRFKPEPLKDRGLAGVRKDSVFYLERKDNKPYTVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASVSAIESTAWYGITARGSKVMPGDYQYVVTYRDEHGKEHQKQYTISVNDKKPMITQGRFDTINGVDHFTPDKTKALGSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKITMLATSQITAHFDHLLPEGSRVSLKTAQDQLIPLEQSLYVPKAYGKTVQEGTYEVVVSLPKGYRIEGNTKVNTLPNEVHELSLRLVKVGDASDSTGDHKVMSKNNSQALTASATPTKSTTSATAKALPSTGEKMGLKLRIVGLVLLGLTCVFSRKKSTKD

SEQ ID NO: 11 - protein, 1647 aa, Streptococcus pyogenes
VEKKQRFSLRKYKSGTFSVLIGSVFLVMTTTVAADELSTMSEPTITNHAQQQAQHLTNTELSSAESKSQDTSQITLKTNREKEQSQDLVSEPTTTELADTDAASMANTGSDATQKSASLPPVNTDVHDWVKTKGAWDKGYKGQGKVVAVIDTGIDPAHQSMRISDVSTAKVKSKEDMLARQKAAGINYGSWINDKVVFAHNYVENSDNIKENQFEDFDEDWENFEFDAEAEPKAIKKHKIYRPQSTQAPKETVIKTEETDGSHDIDWTQTDDDTKYESHGMHVTGIVAGNSKEAAATGERFLGIAPEAQVMFMRVFANDIMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKDIKDSLGYDKSHQFAYVKESTDAGYNAQDVKGKIALIERDPNKTYDEMIALAKKHGALGVLIFNNKPGQSNRSMRLTANGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKDKTLRYDTELLTDHVDPQKGRFTLTSHSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGHYHYVVSYYPDVVGAKRQEMTFDMILDRQKPVLSQATFDPETNRFKPEPLKDRGLAGVRKDSAFYLERKDNKPYTVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASVSAIESTAWYGITARGSKVMPGDYQYVVTYRDEHGKEHQKQYTISVNDKKPMITQGRFDTINGVDHFTPDKTKALGSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKITMLATSQITAHFDHLLPEGSRVSLKTAQDQLIPLEQSLYVPKAYGKTVQEGTYEVVVSLPKGYRIEGNTKVNTLPNEVHELSLRLVKVGDASDSTGDHKVMSKNNSQALTASATPTKSTTSATAKALPSTGEKMGLKLRIVGLVLLGLTCVFSRKKSTKD

SEQ ID NO: 12 - protein, 1647 aa, Streptococcus pyogenes; identical to SEQ ID NO: 11

SEQ ID NO: 13 - protein, 1647 aa, Streptococcus pyogenes; identical to SEQ ID NO: 11

SEQ ID NO: 14 - protein, 1647 aa, Streptococcus pyogenes
VEKKQRFSLRKYKSGTFSVLIGSVFLVMTTTVAANELSTMSEPTITNHAQQQAQHLTNTELSSAESKPQDTSQITPKTNREKEQSQDLVSEPTTTELADTDAAPMADTGPDATQKSASLPPVNTDVHDWVKTKGAWDKGYKGQGKVVAVIDTGIDPAHQSMRISDVSTAKVKSKEDMLARQKAAGINYGSWINDKVVFAHNYVENSDNIKENQFEDFDEDWENFEFDADAEPKAIKKHKIYRPQSTQAPKETVIKTEETDGSHDIDWTQTDDDTKYESHGMHVTGIVAGNSKEAAATGERFLGIAPEAQVMFMRVFANDVMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKNIKDSLGYDKSHQFAYVKESTDAGYKAQDVKGKIALIERDPNKTYDEMIALAKKHGALGVLIFNNKPGQSNRSMRLTANGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKAKTLRYDTELLTDHVDPQKGRFTLTSRSLKTYQGGEVTVPANGKVTVKVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGYYHYVVSYYPDVVGAKRQEMTFDMILDRQKPVLSQATFDPETNRFKPEPLKDRGLAGVRKDSVFYLERKDNKPYTVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASASAIESTAWYGITARGSKVMPGDYQYVVTYRDEHGKEHQKQYTISVNDKKPMITQGRFDTINGVDHFTPDKTKALGSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKMTMLATSQITAHFDHLLPEGSRVSLKTAQGQLIPLEQSLYVPKAYGKTVQEGTYEVVVSLPKGYRIEGNTKVNTLPNEVHELSLRLVKVGDASDSTGDHKVMSKNNSQALTASATPTKTTTSATAKALPSTGEKMGLKLRIVGLVLLGLTCVFSRKKSTKD

SEQ ID NO: 15 - protein, 1647 aa, Streptococcus pyogenes
VEKKQRFSLRKYKSGTFSVLIGSVFLVMTTTVAADELSTMSEPTITNHAQQQAQHLTNTELSSAESKSQDTSQITPKTNREKEQSQDLVSEPTTTELADTDAASMANTGSDATQKSASLPPVNTDVHDWVKTKGAWDKGYKGQGKVVAVIDTGIDPAHQSMRISDVSTAKVKSKEDMLARQKAAGINYGSWINDKVVFAHNYVENSDNIKENQFEDFDEDWENFEFDADAEPKAIKKHKIYRPQSTQAPKETVIKTEETDGSHDIDWTQTDDDTKYESHGMHVTGIVAGNSKEAAATGERFLGIAPEAQVMFMRVFANDVMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKDIKDSLGYDKSHQFAYVKESTDAGYKAQDVKDKIALIERDPNKTYDEMIALAKKHGALGVLIFNNKPGQSNRSMRLTANGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNVTDTMTFDVTVHNLSNKAKTLRYDTELLTDHVDPQKGRFTLTSRSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGYYHYVVSYYPDVVGAKRQEMTFDMILDRQKPVLSQATFDPETNRFKPEPLKDRGLAGVRKDSVFYLERKDNKPYIVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASASAIESTAWYGITARGSKVMPGDYQYVVTYRDEHGKEHQKQYTISVNDKKPMITQGRFDTINGVDHFTPDKTKALGSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKMTILATSQITAHFDHLLPEGSRVSLKTAQGQLIPLEQSLYVPKAYGKTVQEGTYEVVVSLPKGYRIEGNTKVNALPNEVHELSLRLVKVGDASDSTGDHKVMSKNNSQALTASATPTKTTTSATAKALPSAGEKMGLKLRIVGLVLLGLTCVFSRKKSTKD

SEQ ID NO: 16 - protein, 1646 aa, Streptococcus pyogenes
VEKKQRFSLRKYKSGTFSVLIGSAFLMMTTTVAADELSTMSEPTITNHTQQQAQHLTNTELSSAESKSQDTSQITPKTNREKEQSQDLVSEPTTELADTDAAPMANTGPDATQKSASLPPVNTDVHDWVKTKGAWDKGYKGQGKVVAVIDTGIDPAHQSMRISDVSTAKVKSKEDMLARQKAAGINYGSWINDKVVFAHNYVENSDNIKENQFEDFDEDWENFEFDADAEPKAIKKHKIYRPQSTQAPKETVIKTEETDGSHDIDWTQTDDDTKYESHGMHVTGIVAGNSKEAAATGERFLGIAPEAQVMFMRVFANDVMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKNIKDSLGYDKSHQFAYVKESTDAGYKAQDVKDKIALIERDPNKTYDEMIALAKKHGALGVLIFNNKPGQSNRSMRLTANGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNVTDTMTFDVTVHNLSNKAKTLRYDTELLTDHVDPQKGRFTLTSRSLKTYQGGEVTVPANGKVTVRVTMDVSQFTKELTKQMPNGYYLEGFVRFRDSQDAQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGYYHYVVSYYPDVVGAKRQEMTFDMILDRQKPVLSQATFDPETNRFKPEPLKDRGLAGVRKDSVFYLERKDNKPYTVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASASAIESTAWYGITARGSKVMPGDYQYVVTYRDEHGKEHQKQYTISVNDKKPMITQGRFDTINGVDHFTPDKTKALGSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKMTMLATSQITAHFDHLLPEGSRVSLKTAQGQLIPLEQSLYVPKAYGKTVQEGTYEVVVSLPKGYRIEGNTKVNALPNEVHELSLRLVKVGDASDSTGDHKVMSKNNSQALTASARPTKTTTSATAKALPSAGEKMGLKLRIVGLVLLGLTCVFSRKKSTKE

SEQ ID NO: 17 - protein, 1645 aa, Streptococcus pyogenes
VEKKQRFSLRKYKSGTFSVLIGSVFLVMTTTVAADELSTMSEPTITNHAQQQAQHLTNTELSSAESKTQDTSQITPKTNREKEQPQGLVSEPTTTELADTDAASMADTGPDATQKSASLPPVNTDVHDWVKTKGAWDKGYKGQGKVVAVIDTGIDPAHQSMRISDVSTAKVKSKEDMLARQKAAGINYGSWINDKVVFAHNYVENSDNIKENQFGDFDEDWENFEFDAEPKAIKKNKIYRPQSTQAPKETVIKTEETDGSHDIDWTQTDDETKYESHGMHVTGIVAGNSKEAAATGERFLGIAPEAQVMFMRVFANDVMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKNIKDSLGYDKSHQFAYVKESTDAGYKAQDVKDKIALIERDPNKTYDEMIALAKKHGALGVLIFNNKPGQSNRSMRLTANGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKAKTLRYDTELLTDHVDPQKGRFTLTSRSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGHYHYVVSYYPDVVGAKRQEMTFDMILDRQKPVLSQATFDPETNRFKPEPLKDRGLAGVRKDSVFYLERKDNKPYTVTINDSYKYVSVADNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASASAIESTAWYGITARGSKVMPGDYQYVVTYRDEHGKEHQKQYTISVNDKKPMITQGRFDTINGVDHFTPDKTKALGSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKMTMLATSQITAHFDHLLPEGSRVSLKTAQGQLIPLEQSLYVPKAYGKTVQEGTYEVVVSLPKGYRIEGNTKVNTLPNEVHELSLRLVKVGDASDSTGDHKVMSKNNSQALTASATPTKTTTSATAKALPSAGEKMGLKLRIVGLVLLGLTCVFSRKKSTKD

SEQ ID NO: 18 - protein, 1646 aa, Streptococcus pyogenes
VEKKQRFSLRKYKSGTFSVLIGSVFLMMTTTVAADELSTMSEPTITNHTQQQAQHLTNTELSSAESKSQDTSQITPKTNREKEQPQGLVSEPTTELADTDAAPMANTGPDATQKSASLPPVNTDVHDWVKTKGAWDKGYKGQGKVVAVIDTGIDPAHQSMRISDVSTAKVKSKEDMLARQKAAGINYGSWINDKVVFAHNYVENSDNIKENQFGDFDEDWENFEFDAEAEPKAIKKHKIYRPQSTQAPKETVIKTEETDGSHDIDWTQTDDDTKYESHGMHVTGIVAGNSKEAAATGERFLGIAPEAQVMFMRVFANDVMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKNIKDSLGYDKSHQFAYVKESTDAGYKAQDVKGKIALIERDPNKTYDEMIALAKKHGALGVLIFNNKPGQSNRSMRLTANGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKAKTLRYDTELLTDHVDPQKGRFTLTSRSLKTYQGGEVTVPANGKVTVKVTMDVSQFTKELTKQMPNGYYLEGFVRFRDSQDAQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGYYHYVVSYYPDVVGAKRQEMTFDMILDRQKPVLSQATFDPETNRFKPEPLKDRGLAGVRKDSVFYLERKDNKPYTVTINDSYKYVSVADNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASASAIESTAWYGITARGSKVMPGDYQYVVTYRDEHGKEHQKQYTISVNDKKPMITQGRFDTINGVDHFTPDKTKALGSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKMTMLATSQITAHFDHLLPEGSRVSLKTAQGQLIPLEQSLYVPKAYGKTVQEGTYEVVVSLPKGYRIEGNTKVNTLPNEVHELSLRLVKVGDASDSTGDHKVMSKNNSQALTASATPTKTTTSATAKALPSAGEKMGLKLRIVGLVLLGLTCVFSRKKSTKD

SEQ ID NO: 19 - protein, 1647 aa, Streptococcus pyogenes
VEKKQRFSLRKYKSGTFSVLIGSVFLMMMTTTTVAADELTTTSEPTITNHAQQQAQHLTNTELSSAESQSPDTSQITPKTNREKEQPQGLVSEPTTTELADTDAASMANTGPDATQKSASLPPVNTDVHDWVKTKGAWDKGYKGQGKVVAVIDTGIDPAHQSMRISDVSTAKVKSKEDMLARQKAAGINYGSWINDKVVFAHNYVENSDNIKENQFGDFDEDWENFEFDAEPKAIKKNKIYRPQSTQAPKETVIKTEETDGSHDIDWTQTDDDTKYESHGMHVTGIVAGNSKEAAATGERFLGIAPEAQVMFMRVFANDVMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTAKELENRADLNHGKAIYSESVDFKNIKDSLGYDKSHQFAYVKESTDAGYKAQDVKDKIALIERDPNKTYDEMIALAKKHGALGVLIFNNKPGQSNRSMRLTANGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKDKTLRYDTELLTDHVDPQKGRFTLTSRSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGYYHYVVSYYPDVVGAKRQEMTFDMILDRQKPVLSQATFDPETNRFKPEPLKDRGLAGVRKDSVFYLERKDNKPYTVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASASAIESTAWYGITARGSKVMPGDYQYVVTYRDEHGKEHQKQYTISVNDKKPMITQGRFDTINGVDHFTPDKTKALGSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKMTMLATSQITAHFDHLLPEGSRVSLKTAQGQLIPLEQSLYVPKAYGKTVQEDTYEVVVSLPKGYRIEGNTKVNTLPNEVHELSLRLVKVGDASDSTGDHKVMSKNNSQALTASATPTKTTTSATAKALPSTGEKMGLKLRIVGLVLLGLTCVFSRKKSTKD

SEQ ID NO: 20 - protein, 1647 aa, Streptococcus pyogenes
VEKKQRFSLRKYKSGTFSVLIGSVFLMMMTTTTVAADELTTTSEPTITNHAQQQAQHLTNTELSSAESQSPDTSQITPKTNREKEQPQGLVSEPTTTELADTDAASMANTGPDATQKSASLPPVNTDVHDWVKTKGAWDKGYKGQGKVVAVIDTGIDPAHQSMRISDVSTAKVKSKEDMLARQKAAGINYGSWINDKVVFAHNYVENSDNIKENQFGDFDEDWENFEFDAEPKAIKKNKIYRPQSTQAPKETVIKTEETDGSHDIDWTQTDDDTKYESHGMHVTGIVAGNSKEAAATGERFLGIAPEAQVMFMRVFANDVMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTAKELENRADLNHGKAIYSESVDFKNIKDSLGYDKSHQFAYVKESTDAGYKAQDVKDKIALIERDPNKTYDEMIALAKKHGALGVLIFNNKPGQSNRSMRLTANGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKDKTLRYDTELLTDHVDPQKGRFTLTSRSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGYYHYVVSYYPDVVGAKRQEMTFDMILDRQKPVLSQATFDPETNRFKPEPLKDRGLAGVRKDSVFYLERKDNKPYTVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASASAIESTAWYGITARGSKVMPGDYQYVVTYRDEHGKEHQKQYTISVNDKKPMITQGRFDTINGVDHFTPDKTKALGSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKMTMLATSQITAHFDHLLPEGSRVSLKTAQGQLIPLEQSLYVPKAYGKTVQEDTYEVVVSLPKGYRIEGNTKVNALPNEVHELSLRLVKVGDASDSTGDHKVMSKNNSQALTVSATPTKTTTSATAKALPSAGEKMGLKLRIVGLVLLGLTCVFSRKKSTKD

SEQ ID NO: 21 - protein, 1647 aa, Streptococcus pyogenes; identical to SEQ ID NO: 20

SEQ ID NO: 22 - protein, 1647 aa, Streptococcus pyogenes
VEKKQRFSLRKYKSGTFSVLIGSVFLMMMTTTTVAADELTTTSEPTITNHAQQQAQHLTNTELSSAESQSPDTSQITPKTNREKEQPQGLVFEPTTTELADTDAASMANTGPDATQKSASLPPVNTDVHDWVKTKGAWDKGYKGQGKVVAVIDTGIDPAHQSMRISDVSTAKVKSKEDMLARQKAAGINYGSWINDKVVFAHNYVENSDNIKENQFGDFDEDWENFEFDAEPKAIKKNKIYRPQSTQAPKETVIKTEETDGSHDIDWTQTDDDTKYESHGMHVTGIVAGNSKEAAATGERFLGIAPEAQVMFMRVFANDVMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTAKELENRADLNHGKAIYSESVDFKNIKDSLGYDKSHQFAYVKESTDAGYKAQDVKDKIALIERDPNKTYDEMIALAKKHGALGVLIFNNKPGQSNRSMRLTANGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKDKTLRYDTELLTDHVDPQKGRFTLTSRSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGYYHYVVSYYPDVVGAKRQEMTFDMILDRQKPVLSQATFDPETNRFKPEPLKDRGLAGVRKDSVFYLERKDNKPYTVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASASAIESTAWYGITARGSKVMPGDYQYVVTYRDEHGKEHQKQYTISVNDKKPMITQGRFDTINGVDHFTPDKTKALGSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKMTMLATSQITAHFDHLLPEGSRVSLKTAQGQLIPLEQSLYVPKAYGKTVQEDTYEVVVSLPKGYRIEGNTKVNALPNEVHELSLRLVKVGDASDSTGDHKVMSKNNSQALTVSATPTKTTTSATAKALPSAGEKMGLKLRIVGLVLLGLTCVFSRKKSTKD

SEQ ID NO: 23 - protein, 1646 aa, Streptococcus pyogenes
VEKKQRFSLRKYKSGTFSVLIGSVFLMMMTTTVAADELTTTSEPTITNHAQQQAQHLTNTELSSAESQSPDTSQITPKTNREKEQPQGLVSEPTTTELADTDAASMANTGPDATQKSASLPPVNTDVHDWVKTKGAWDKGYKGQGKVVAVIDTGIDPAHQSMRISDVSTAKVKSKEDMLARQKAAGINYGSWINDKVVFAHNYVENSDNIKENQFEDFDEDWENFEFDAEPKAIKKNKIYRPQSTQAPKETVIKTEETDGSHDIDWTQTDDETKYESHGMHVTGIVAGNSKEAAATGERFLGIAPEAQVMFMRVFANDVMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKDIKDSLGYDKSHQFAYVKESTDAGYNAQDVKGKIALIERDPNKTYDEMIALAKKHGALGVLIFNNKPGQSNRSMRLTSNGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKDKTLRYDTELLTDHVDPQKGRFTLTSRSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGYYHYVVSYYPDVVGAKRQEMTFDMILDRQKPVLSQATFDPETNRFKPEPLKDRGLAGVRKDSVFYLERKDNKPYTVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASASAIESTAWYGITARGSKVMPGDYQYVVTYRDEHGKVHQKQYTISVNDKKPMITQGRFDTINGVDHFTPDKTKALGSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKMTMLATSQITAHFDHLLPEGSRVSLKTAQGQLIPLEQSLYVPKAYGKTVQEGTYEVVVSLPKGYRIEGNTKVNALPNEVHELSLRLVKVGDASDSTGDHKVMSKNNSQALTASATPTKTTTSATAKALPSTGEKMGLKLRIVGLVLLGLTCVFSRKKSTKD

SEQ ID NO: 24 - protein, 1647 aa, Streptococcus pyogenes
VEKKQRFSLRKYKSGTFSVLIGSVFLMMMMTTTVAADELTTTSEPTITNHAQQQAQHLTNTELSSAESQSPDTSQITPKTNREKEQPQGLVSEPTTTELADTDAASMANTGPDATQKSASLPPVNTDVHDWVKTKGAWDKGYKGQGKVVAVIDTGIDPAHQSMRISDVSTAKVKSKEDMLARQKAAGINYGSWINDKVVFAHNYVENSDNIKENQFEDFDEDWENFEFDAEPKAIKKNKIYRPQSTQAPKETVIKTEETDGSHDIDWTQTDDETKYESHGMHVTGIVAGNSKEAAATGERFLGIAPEAQVMFMRVFANDVMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKDIKDSLGYDKSHQFAYVKESTDAGYNAQDVKGKIALIERDPNKTYDEMIALAKKHGALGVLIFNNKPGQSNRSMRLTSNGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKDKTLRYDTELLTDHVDPQKGRFTLTSRSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGYYHYVVSYYPDVVGAKRQEMTFDMILDRQKPVLSQATFDPETNRFKPEPLKDRGLAGVRKDSVFYLERKDNKPYTVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASASAIESTAWYGITARGSKVMPGDYQYVVTYRDEHGKVHQKQYTISVNDKKPMITQGRFDTINGVDHFTPDKTKALGSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKMTMLATSQITAHFDHLLPEGSRVSLKTAQGQLIPLEQSLYVPKAYGKTVQEGTYEVVVSLPKGYRIEGNTKVNALPNEVHELSLRLVKVGDASDSTGDHKVMSKNNSQALTASATPTKTTTSATAKALPSTGEKMGLKLRIVGLVLLGLTCVFSRKKSTKD

SEQ ID NO: 25 - protein, 1645 aa, Streptococcus pyogenes
VEKKQRFSLRKYKSGTFSVLIGSVFLMMTTTVAADELTTTSEPTITNHAQQQAPPLTNTELSSAESQPQDTSQVTPETNREKEQPQGLVSEPTTTELADTDAAPMANTGSDATQKSASLPPVNTDVHDWVKTKGAWDKGYKGQGKVVAVIDTGIDPAHQSMRISDVSTAKVKSKEDMLARQKAAGINYGSWINDKVVFAHNYVENSDNIKENQFGDFDEDWENFEFDAEPKAIKKNKIYRPQSTQAPKETVIKTEETDGSHDIDWTQTDDETKYESHGMHVTGIVAGNSKEAAATGERFLGIAPEAQVMFMRVFANDVMGSAESLFIKAIEDAVALGADVINLSLGTANGAQLSGSKPLIEAIEKAKKAGVSVVVAAGNERVYGSDHDDPLATNPDYGLVGSPSTGRTPTSVAAINSKWVIQRLMTVKELENRADLNHGKAIYSESVDFKDIKDSLGYDKSHQFAYVKESTDAGYKAQDVKGKIALIERDPNKTYDEMIALAKKHGALGVLIFNNKPGQSNRSMRLTANGMGIPSAFISYEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKAKTLRYDTELLTDHVDPQKGRFTLTSRSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGYYHYVVSYYPDVVGAKRQEMTFDMILDRQKPVLSQATFDPETNRFKPEPLKDRGLAGVRKDSVFYLERKDNKPYTVTINDSYKYVSVADNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASASAIESTAWYGITARGSKVMPGDYQYVVTYRDEHGKEHQKQYTISVNDKKPMITQGRFDTINGVDHFTPDKTKALGSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKMTMLATSQITAHFDHLLPEGSRVSLKTAQGQLIPLEQSLYVPKAYGKTVQEGTYEVVVSLPKGYRIEGNTKVNALPNEVHELSLRLVKVGDASDSTGDHKVMSKNNSQALTASATPTKTTTSATAKALPSTGEKMGLKLRIVGLVLLGLTCVFSRKKSTKD

SEQ ID NO: 26 - protein, 1645 aa, Streptococcus pyogenes; identical to SEQ ID NO: 25

SEQ ID NO: 27 - protein, 1645 aa, Streptococcus pyogenes
VEKKQRFSLRKYKSGTFSVLIGSVFLMMTTTVAADELTTTSEPTITNHAQQQAQPLTNTELSSAESQSPHTSQVTPETNREKEQSQDLVSKPTTTELADTDAAPMANTGPDATQKSASLPPVNTDVHDWVKTKGAWDKGYKGQGKVVAVIDTGIDPAHQSMHISDVSTAKVKSKEDMLARQKAAGINYGSWINDKVVFAHNYVENSDNIKENQFGDFDEDWENFEFDAEPKAIKKHKIYRPQSTQAPKETVIKTEETDGSHDIDWTQTDDETKYESHGMHVTGIVAGNSKEAAATGERFLGIAPEAQVMFMRVFANDVMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKDIKDSLGYDKSHQFAYVKESTDAGYNAQDVKGKIALIERDPNKTYDEMIALAKKHGALGVLIFNNKPGQSNRSMRLTANGMGIPSAFISHEFGKAMSQLNGNGTGSLVFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKAKTLRYDTELLTDHVDPQKGRFTLTSRSLKTYQGGEVTVPANGKVTVKVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGYYHYVVSYYPDVVGAKRQEMTFDMILDRQKPVLSQATFDPETNRFKPEPLKDRGLAGVRKDSVFYLERKDNKPYTVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASASAIESTAWYGITARGSKVMPGDYQYVVTYRDEHGKEHQKQYTISVNDKKPMITQGRFDTINGVDHFTPDKTKALGSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKMTMLATSQITAHFDHLLPEGSRVSLKTAQGQLIPLEQSLYVPKAYGKTVQEGTYEVVVSLPKGYRIEGNTKVNALPNEVHELSLRLVKVGDASDLTGDHKVMSKNNSQALTASATPTKTTTSATAKALPSAGEKMGLKLRIVGLVLLGLTCVFSRKKSTKD

SEQ ID NO: 28 - protein, 1645 aa, Streptococcus pyogenes; identical to SEQ ID NO: 27

SEQ ID NO: 29 - protein, 1645 aa, Streptococcus pyogenes
VEKKQRFSLRKYKSGTFSVLIGSVFLMMTTTVAADELTTTSEPTITNHAQQQAQPLTNTELSSAESQSPHTSQVTPETNREKEQSQDLVSKPTTTELADTDAAPMANTGPDATQKSASLPPVNTDVHDWVKTKGAWDKGYKGQGKVVAVIDTGIDPAHQSMHISDVSTAKVKSKEDMLARQKAAGINYGSWINDKVVFAHNYVENSDNIKENQFGDFDEDWENFEFDAEPKAIKKHKIYRPQSTQAPKETVIKTEETDGSHDIDWTQTDDETKYESHGMHVTGIVAGNSKEAAATGERFLGIAPEAQVMFMRVFANDVMGSAESLFIKAIEDAVALGADVINLSLGTANGAQLSGSKPLMEAIEKAKKAGVSVVVAAGNERVYGFDHDDPLATNPDYGLVGSPSTGRTPTSVAAINSKWVIQRLMTVKELENRADLNHGKAIYSESVDFKDIKDSLGYDKSHQFAYVKESTDAGYNAQDVKGKIALIERDPNKTYDEMIALAKKHGALGVLIFNNKPGQSNRSMRLTANGMGIPSAFISHEFGKAMSQLNGNGTGSLVFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKAKTLRYDTELLTDHVDPQKGRFTLTSRSLKTYQGGEVTVPANGKVTVKVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGYYHYVVSYYPDVVGAKRQEMTFDMILDRQKPVLSQATFDPETNRFKPEPLKDRGLAGVRKDSVFYLERKDNKPYTVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASASAIESTAWYGITARGSKVMPGDYQYVVTYRDEHGKEHQKQYTISVNDKKPMITQGRFDTINGVDHFTPDKTKALGSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKMTMLATSQITAHFDHLLPEGSRVSLKTAQGQLIPLEQSLYVPKAYGKTVQEGTYEVVVSLPKGYRIEGNTKVNALPNEVHELSLRLVKVGDASDLTGDHKVMSKNNSQALTASATPTKTTTSATAKALPSAGEKMGLKLRIVGLVLLGLTCVFSRKKSTKD

SEQ ID NO: 30 - protein, 1647 aa, Streptococcus pyogenes
VEKKQRFSLRKYKSGTFSVLVGSVFLMMTTTVAADELTTTSEPTITNHAQQQAQPLTNTELSSAESQSPDTSQVTPETNREKEQSQDLVSKPTTTELADTDAAPMANTGPDATQKSASLPPVNTDVHDWVKTKGAWDKGYKGQGKVVAVIDTGIDPAHQSMRISDVSTAKVKSKEDMLARQKAAGINYGSWINDKVVFAHNYVENSDNIKENQFGDFDEDWENFEFDADAEPKAIKKHKIYRPQSTQAPKETVIKTEETDGSHDIDWTQTDDETKYESHGMHVTGIVAGNSKEAAATGERFLGIAPEAQVMFMRVFANDVMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKDIKDSLGYDKSHQFAYVKESTDAGYNAQDVKGKIALIERDPNKTYDEMIALAKKHGALGVLIFNNKPGQSNRSMRLTANGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKDKTLRYDTELLTDHVDPQKGRFTLTSRSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGYYHYVVSYYPDVVGAKRQEMTFDMILDRQKPVLSQATFDPETNRFKPEPLKDRGLAGVRKDSVFYLERKDNKPYTVTINDSYKYVSVADNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASASAIESTAWYGITARGSKVMPGDYQYVVTYRDEHGKEHQKQYTISVNDKKPMITQGRFDTINGVDHFTPDKTKALGSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKMTMLATSQITAHFDHLLPEGSRVSLKTAQGQLIPLGQSLYVPKAYGKTVQEGTYEVVVSLPKGYRIEGNTKVNALPNEVHELSLRLVKVGDASDSTGDHKVMSKNNSQALTASATPTKTTTSATAKALPSAGEKMGLKLRIVGLVLLGLTCVFSRKKSTKD

SEQ ID NO: 31 - protein, 1647 aa, Streptococcus pyogenes; identical to SEQ ID NO: 30

SEQ ID NO: 32 - protein, 1645 aa, Streptococcus pyogenes
VEKKQRFSLRKYKSGTFSVLIGSVFLMMTTTVAADELTTTSEPTITNHAQQQAQPLTNTELSSAESQSPDTSQITPKTNREKEQSQDLVSKPTTTELADTDSAPMANTGPDATQKSASLPPVNTDVHDWVKTKGAWDKGYKGQGKVVAVIDTGIDPAHQSMRISDVSTAKVKSKEDMLARQKAAGINYGSWINDKVVFAHNYVENSDNIKENQFGDFDEDWENFEFDAEPKAIKKHKIYRPQSTQAPKETVIKTEETDGSHDIDWTQTDDETKYESHGMHVTGIVAGNSKEAAATGERFLGIAPEAQVMFMRVFANDVMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELESRADLNHGKAIYSESVDFKDIKDSLGYDKSHQFAYVKESTDAGYKAQDVKGKIALIERDPNKTYDEMIALAKKHGALGVLIFNNKPGQSNRSMRLTANGMGIPSAFISHEFGKAMSQLNTNGTGSLVFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKMTTSPRQQGAGLLNIDGAVTSGLYVTGKDNYGSISLGNITDTMTFDVTVHNLSNKAKTLRYDTELLTDHVDPQKGHFTLTSRSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGYYHYVVSYYPDVVGAKRQEMTFDMILDRQKPVLSQATFDPETNRFKPEPLKDRGLAGVRKDSVFYLERKDNKPYTVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASASAIESTAWYGITARGSKVMPGDYQYVVTYRDEHGKEHQKQYTISVNDKKPMITQGRFDTINGVDHFTPDKTKALGSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKMTMLATSQITAHFDHLLPEGSRVSLKTAQGQLIPLEQSLYVPKAYGKTVQEGTYEVVVSLPKGYRIEGNTKVNTLPNEVHELSLRLVKVGDASDSTGDHKVMSKNNSQALTASATPTKTTTSATAKALPSAGEKMGLKLRIVGLVLLGLTCVFSRKKSTKD

SEQ ID NO: 33 - protein, 1645 aa, Streptococcus pyogenes
VEKKQRFSLRKYKSGTFSVLIGSVFLMMTTTVAADELTTTSEPTITNHAQQQAQHLTNTELSSAESQSPDTSQITPKINREKEQPQGLVSEPTTTELADTDAAPMANTGPDATQKSASLPPVNTDVHDWVKTKGAWDKGYKGQGKVVAVIDTGIDPAHQSMRISDVSTAKVKSKEDMLARQKAAGINYGSWINDKVVFAHNYVENSDNIKENQFEDFDEDWENFEFDAEPKAIKKHKIYRPQSTQAPKETVIKTEETDGSHDIDWTQTDDDTKYESHGMHVTGIVAGNSKEAAATGERFLGIAPETQVMFMRVFANDVMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKDIKDSLGYDKSHQFAYVKESTDAGYNAQDVKGKIALIERDPNKTYDEMIALAKKHGALGVLIFNNKPGQSNRSMRLTANGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKAKTLRYDTELLTDHVDPQKGRFTLTSRSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGYYHYVVSYYPDVVGAKRQEMTFDMILDRQKPVLSQATFDPETNRFKPEPLKDRGLAGVRKDSVFYLERKDNKPYTVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASASAIESTAWYGITARGSKVMPGDYQYVVTYRDEHGKEHQKQYTISVNDKKPMITQGRFDTINGVDHFTPDKTKALGSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKMTMLATSQITAHFDHLLPEGSRVSLKTAQGQLIPLEQSLYVPKAYGKTVQEGTYEVVVSLPKGYRIEGNTKVNTLPNEVHELSLRLVKVGDASDSTGDHKVMSKNNSQALTASATPTKTTTSATAKALPSAGEKMGLKLRIVGLVLLGLTCVFSRKKSTKD

SEQ ID NO: 34 - protein, 1645 aa, Streptococcus pyogenes; identical to SEQ ID NO: 33

SEQ ID NO: 35 - protein, 1645 aa, Streptococcus pyogenes; identical to SEQ ID NO: 33

SEQ ID NO: 36 - protein, 1645 aa, Streptococcus pyogenes; identical to SEQ ID NO: 33

SEQ ID NO: 37 - protein, 1645 aa, Streptococcus pyogenes
VEKKQRFSLRKYKSGTFSVLIGSVFLMMTTTVAADELTTTSEPTITNHAQQQAQHLTNTELSSAESQSPDTSQITPKINREKEQPQGLVSEPTTTELADTDAAPMANTGPDATQKSASLPPVNTDVHDWVKTKGAWDKGYKGQGKVVAVIDTGIDPAHQSMRISDVSTAKVKSKEDMLARQKAAGINYGSWINDKVVFAHNYVENSDNIKENQFEDFDEDWENFEFDAEPKAIKKHKIYRPQSTQAPKETVIKTEETDGSHDIDWTQTDDDTKYESHGMHVTGIVAGNSKEAAATGERFLGIAPETQVMFMRVFANDVMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKDIKDSLGYDKSHQFAYVKESTDAGYNAQDVKGKIALIERDPNKTYDEMIALAKKHGALGVLIFNNKPGQSNRSMRLTANGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKAKTLRYDTELLTDHVDPQKGRFTLTSRSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGYYHYVVSYYPDVVGAKRQEMTFDMILDRQKPVLSQATFDPETNRFKPEPLKDRGLAGVRKDSVFYLERKDNKPYTVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASASAIESTAWYGITARGSKVMPGDYQYVVTYRDEHGKEHQKQYTISVNDKKPMITQGRFDTINGVDHFTPDKTKALGSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKMTMLATSQITAHFDHLLPEGSRVSLKTAQGQLIPLEQSLYVPKAYGKTVQEGTYEVVVSLPKGYRIEGNTKVNTLPNEVHELSLRLVKVGDASDSTGDHKVMSKNNSQALTAFATPTKTTTSATAKALPSAGEKMGLKLRIVGLVLLGLTCVFSRKKSTKD

SEQ ID NO: 38 - protein, 1645 aa, Streptococcus pyogenes; identical to SEQ ID NO: 33

SEQ ID NO: 39 - protein, 1648 aa, Streptococcus pyogenes
VEKKQRFSLRKYKSGTFSVLIGSVFLMMMTTTVAADELTTTSEPTITNHAQQQAQHLTNTELSSAESKPQDTSQITPKTNREKEQSQDLVSEPTTTELADTDAASMANTGPDATQKSASLPPVNTDVHDWVKTKGAWDKGYKGQGKVVAVIDTGIDPAHQSMRISDVSTAKVKSKEDMLARQKAAGINYGSWINDKVVFAHNYVENSDNIKENQFEDFDEDWENFEFDAEAEPKAIKKHKIYRPQSTQAPKETVIKTEETDGSHDIDWTQTDDDTKYESHGMHVTGIVAGNSKEAAATGERFLGIAPEAQVMFMRVFANDVMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKNIKDSLGYDKSHQFAYVKESTDAGYNAQDVKGKIALIERDPNKTYDEMIALAKKHGALGVLIFNNKPGQSNRSMRLTSNGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKAKTLRYDTELLTDHVDPQKGRFTLTSRSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGYYHYVVSYYPDVVGAKRQEMTFDMILDRQKPVLSQATFDPETNRFKPEPLKDRGLAGVRKDSVFYLERKDNKPYTVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASASAIESTAWYGITARGSKVMPGDYQYVVTYRDEHGKEHQKQYTISVNDKKPMITQGRFDTINGVDHFTPDKTKALGSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQITFKMTMLATSQITAHFDHLLPEGSRVSLKTAQGQLIPLEQSLYVPKAYGKTVQEGTYEVVVSLPKGYRIEGNTKVNTLPNEVHELSLRLVKVGDASDSTGDHKVMSKNNSQALTASATPTKTTTSATAKALPSAGEKMGLKLRIVGLVLLGLTCVFSRKKSTKD

SEQ ID NO: 40 - protein, 1649 aa, Streptococcus pyogenes
VEKKQRFSLRKYKSGTFSVLIGSVFLMMMMTTTVAADELTTTSEPTITNHAQQQAQHLTNTELSSAESKPQDTSQITPKTNREKEQSQDLVSEPTTTELADTDAASMANTGPDATQKSASLPPVNTDVHDWVKTKGAWGKGYKGQGKVVAVIDTGIDPAHQSMRISDVSTAKVKSKEDMLARQKAAGINYGSWINDKVVFAHNYVENSDNIKENQFEDFDEDWENFEFDADAEPKAIKKHKIYRPQSTQAPKETVIKTEETDGSHDIDWTQTDDDTKYESHGMHVTGIVAGNSKEAAATGERFLGIAPEAQVMFMRVFANDVMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKNIKDSLGYDKSHQFAYVKESTDAGYNAQDVKGKIALIERDPNKTYDEMIALAKKHGALGVLIFNNKPGQSNRSMRLTANGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKDKTLRYDTELLTDHVDPQKGRFTLTSRSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGYYHYVVSYYPDVVGAKRQEMTFDMILDRQKPVLSQATFDPETNRFKPEPLKDRGLAGVRKDSVFYLKRKDNKPYTVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASASAIESTAWYGITARGSKVMPGDYQYVVTYRDEHGKVHQKQYTISVNDKKPMITQGRFDTINGVDHFTPDKTKALGSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKMTMLATSQITAHFDHLLPEGSRVSLKTAQGQLIPLEQSLYVPKAYGKTVQEGTYEVVVSLPKGYRIEGNTKVNTLPNEVHELSLRLVKVGDASDSTGDHKVMSKNNSQALTASATPTKTTTSATAKALPSTGEKMGLKLRIVGLVLLGLTCVFSRKKSTKD

SEQ ID NO: 41 - protein, 1649 aa, Streptococcus pyogenes
VEKKQRFSLRKYKSGTFSVLIGSVFLMMMMTTTVAADELTTTSEPTITNHAQQQAQHLTNTELSSAESKPQDTSQITPKTNREKEQSQDLVFEPTTTELADTDAASMANTGPDATQKSASLPPVNTDVHDWVKTKGAWGKGYKGQGKVVAVIDTGIDPAHQSMRISDVSTAKVKSKEDMLARQKAAGINYGSWINDKVVFAHNYVENSDNIKENQFEDFDEDWENFEFDADAEPKAIKKHKIYRPQSTQAPKETVIKTEETDGSHDIDWTQTDDDTKYESHGMHVTGIVAGNSKEAAATGERFLGIAPEAQVMFMRVFANDVMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKNIKDSLGYDKSHQFAYVKESTDAGYNAQDVKGKIALIERDPNKTYDEMIALAKKHGALGVLIFNNKPGQSNRSMRLTANGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKDKTLRYDTELLTDHVDPQKGRFTLTSRSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGYYHYVVSYYPDVVGAKRQEMTFDMILDRQKPVLSQATFDPETNRFKPEPLKDRGLAGVRKDSVFYLERKDNKPYTVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASASAIESTAWYGITARGSKVMPGDYQYVVTYRDEHGKVHQKQYTISVNDKKPMITQGRFDTINGVDHFTPDKTKALGSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKMTMLATSQITAHFDHLLPEGSRVSLKTAQGQLIPLEQSLYVPKAYGKTVQEGTYEVVVSLPKGYRIEGNTKVNTLPNEVHELSLRLVKVGDASDSTGDHKVMSKNNSQALTASATPTKTTTSATAKALPSTGEKMGLKLRIVGLVLLGLTCVFSRKKSTKD

SEQ ID NO: 42 - protein, 1649 aa, Streptococcus pyogenes
VEKKQRFSLRKYKSGTFSVLIGSVFLMMMMTTTVAADELTTTSEPTITNHAQQQAQHLTNTELSSAESKPQDTSQITPKTNREKEQSQDLVSEPTTTELADTDAASMANTGPDATQKSASLPPVNTDVHDWVKTKGAWGKGYKGQGKVVAVIDTGIDPAHQSMRISDVSTAKVKSKEDMLARQKAAGINYGSWINDKVVFAHNYVENSDNIKENQFEDFDEDWENFEFDADAEPKAIKKHKIYRPQSTQAPKETVIKTEETDGSHDIDWTQTDDDTKYESHGMHVTGIVAGNSKEAAATGERFLGIAPEAQVMFMRVFANDVMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKNIKDSLGYDKSHQFAYVKESTDAGYNAQDVKGKIALIERDPNKTYDEMIALAKKHGALGVLIFNNKPGQSNRSMRLTANGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKDKTLRYDTELLTDHVDPQKGRFTLTSRSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGYYHYVVSYYPDVVGAKRQEMTFDMILDRQKPVLSQATFDPETNRFKPEPLKDRGLAGVRKDSVFYLERKDNKPYTVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASASAIESTAWYGITARGSKVMPGDYQYVVTYRDEHGKVHQKQYTISVNDKKPMITQGRFDTINGVDHFTPDKTKALGSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKMTMLATSQITAHFDHLLPEGSRVSLKTAQGQLIPLEQSLYVPKAYGKTVQEGTYEVVVSLPKGYRIEGNTKVNTLPNEVHELSLRLVKVGDASDSTGDHKVMSKNNSQALTASATPTKTTTSATAKALPSTGEKMGLKLRIVGLVLLGLTCVFSRKKSTKE

SEQ ID NO: 43 - protein, 1648 aa, Streptococcus pyogenes
VEKKQRFSLRKYKSGTFSVLIGSVFLMMMTTTVAADELTTTSEPTITNHTQQQAQHLTNTELSSAESKPQDTSQITLKTNREKEQPQGLVSEPTTTELADTDAAPMANTGPDATQKSASLPPVNTDVHDWVKTKGAWDKGYKGQGKVVAVIDTGIDPAHQSMRISDVSTAKVKSKEDMLARQKAAGINYGSWINDKVVFAHNYVENSDNIKENQFEDFDEDWENFEFDAEAEPKAIKKHKIYRPQSTQAPKETVIKTEETDGSHDIDWTQTDDDTKYESHGMHVTGIVAGNSKEAAATGERFLGIAPEAQVMFMRVFANDVMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKNIKDSLGYDKTHQFAYVKESTDAGYKAQDVKGKIALIERDPNKTYDEMIALAKKHGALGVLIFNNKPGQSNRSMRLTANGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKDKTLRYDTELLTDHVDPQKGRFTLTSRSLKTYQGGEVTVPANGKVTVRVTMDVSQFTKELTKQMPNGYYLEGFVRFRDSQDAQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGHYHYVVSYYPDVVGAKRQEMTFDMILDRQKPVLSQATFDPETNRFKPEPLKDRGLAGVRKDSVFYLERKDNKPYTVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASASAIESTAWYGITARGSKVMPGDYQYVVTYRDEHGKEHQKQYTISVNDKKPMITQGRFDTINGVDHFTPDKTKALGSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKMTMLATSQITAHFDHLLPEGSRVSLKTAQGQLIPLEQSLYVPKAYGKTVQEGTYEVVVSLPKGYRIEGNTKVNTLPNEVHELSLRLVKVGDASDSTGDHKVMSKNNSQALTASATPTKTTTSATAKALPSTGEKMGLKLRIVGLVLLGLTCVFSRKKSTKD

SEQ ID NO: 44 - protein, 1648 aa, Streptococcus pyogenes
VEKKQRFSLRKYKSGTFSVLIGSVFLMMMTTTVAADELTTTSEPTITNHTQQQAQHLTNTELSSAESKPQDTSQITLKTNREKEQPQGLVSEPTTTELADTDAAPMANTGPDATQKSASLPPVNTDVHDWVKTKGAWDKGYKGQGKVVAVIDTGIDPAHQSMRISDVSTAKVKSKEDMLARQKAAGINYGSWINDKVVFAHNYVENSDNIKENQFEDFDEDWENFEFDAEAEPKAIKKHKIYRPQSTQAPKETVIKTEETDGSHDIDWTQTDDDTKYESHGMHVTGIVAGNSKEAAATGERFLGIAPEAQVMFMRVFANDVMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKNIKDSLGYDKTHQFAYVKESTDAGYKAQDVKGKIALIERDPNKTYDEMIALAKKHGALGVLIFNNKPGQSNRSMRLTANGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKDKTLRYDTELLTDHVDPQKGRFTLTSRSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGHYHYVVSYYPDVVGAKRQEMTFDMILDRQKPVLSQATFDPETNRFKPEPLKDRGLAGVRKDSVFYLERKDNKPYTVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASASAIESTAWYGITARGSKVMPGDYQYVVTYRDEHGKEHQKQYTISVNDKKPMITQGRFDTINGVDHFTPDKTKALGSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKMTMLATSQITAHFDHLLPEGSRVSLKTAQGQLIPLEQSLYVPKAYGKTVQEGTYEVVVSLPKGYRIEGNTKVNTLPNEVHELSLRLVKVGDASDSTGDHKVMSKNNSQALTASATPTKTTTSATAKALPSTGEKMGLKLRIVGLVLLGLTCVFSRKKSTKD

SEQ ID NO: 45 - protein, 1648 aa, Streptococcus pyogenes
VEKKQRFSLRKYKSGTFSVLIGSVFLMMMTTTVAADELTTTSEPTITNHTQQQAQHLTNTELSSAESKPQDTSQITLKTNREKEQPQGLVSEPTTTELADTDAAPMANTGPDATQKSASLPPVNTDVHDWVKTKGAWDKGYKGQGKVVAVIDTGIDPAHQSMRISDVSTAKVKSKEDMLARQKAAGINYGSWINDKVVFAHNYVENSDNIKENQFEDFDEDWENFEFDAEAEPKAIKKHKIYRPQSTQAPKETVIKTEETDGSHDIDWTQTDDDTKYESHGMHVTGIVAGNSKEAAATGERFLGIAPEAQVMFMRVFANDVMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKNIKDSLGYDKSHQFAYVKESTDAGYNAQDVKGKIALIERDPNKTYDEMIALAKKHGALGVLIFNNKPGQSNRSMRLTANGMGIPSAFISHEFGKVMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKAKTLRYDTELLTDHVDPQKGRFTLTSRSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKMISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGYYHYVVSYYPDVVGAKRQEMTFDMILDRQKPVLSQATFDPETNRFKPEPLKDRGLAGVRKDSVFYLERKDNKPYTVTINDSYKYVSVEDSKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASASAIESTAWYGITARGSKVMPGDYQYVVTYRDEHGKEHQKQYTISVNDKKPMITQGRFDTINGVDHFTPDKTKALGSSGIVREEVFYLAKKNGRKFDVTEGKDGITVSDNKVYIPKNPDGSYTISKRDGVTLSDYYYLVEDRAGNVSFATLRDLKVVGKDKAVVNFGLDLPVPEDKQIVNFTYLVRDADGKPIENLEYYNNSGNSLILPYGKYTVELLTYDTNAAKLESDKIVSFTLSADNNFQQVTFKMTMLATSQITAHFDHLLPEGSRVSLKTAQGQLIPLEQSLYVPKAYGKTVQEGTYEVVVSLPKGYRIEGDTKVNALPNEVHELSLRLVKVGDASDSTGDHKVMSKNNSQALTASATPTKTTTSATAKALPSAGEKMGLKLRIVGLVLLGLTCVFSRKKSTKD

SEQ ID NO: 46 - protein, 1648 aa, Streptococcus pyogenes; identical to SEQ ID NO: 45

SEQ ID NO: 47 - protein, 1648 aa, Streptococcus pyogenes; identical to SEQ ID NO: 45

SEQ ID NO: 48 - protein, 1648 aa, Streptococcus pyogenes; identical to SEQ ID NO: 45

SEQ ID NO: 49 - protein, 1648 aa, Streptococcus pyogenes; identical to SEQ ID NO: 45

SEQ ID NO: 50 - protein, 1648 aa, Streptococcus pyogenes
VEKKQRFSLRKYKSGTFSVLIGSVFLMMMTTTVAADELTTTSEPTITNHTQQQAQHLTNTELSSAESKPQDTSQITLKTNREKEQPQGLVSEPTTTELADTDAAPMANTGPDATQKSASLPPVNTDVHDWVKTKGAWDKGYKGQGKVVAVIDTGIDPAHQSMRISDVSTAKVKSKEDMLARQKAAGINYGSWINDKVVFAHNYVENSDNIKENQFEDFDEDWENFEFDAEAEPKAIKKHKIYRPQSTQAPKETVIKTEETDGSHDIDWTQTDDDTKYESHGMHVTGIVAGNSKEAAATGERFLGIAPEAQVMFMRVFANDVMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKNIKDSLGYDKSHQFAYVKESTDAGYNAQDVKGKIALIERDPNKTYDEMIALAKKHGALGVLIFNNKPGQSNRSMRLTANGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKAKTLRYDTELLTDHVDPQKGRFTLTSRSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKMISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGYYHYVVSYYPDVVGAKRQEMTFDMILDRQKPVLSQATFDPETNRFKPEPLKDRGLAGVRKDSVFYLERKDNKPYTVTINDSYKYVSVEDSKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASASAIESTAWYGITARGSKVMPGDYQYVVTYRDEHGKEHQKQYTISVNDKKPMITQGRFDTINGVDHFTPDKTKALGSSGIVREEVFYLAKKNGRKFDVTEGKDGITVSDNKVYIPKNPDGSYTISKRDGVTLSDYYYLVEDRAGNVSFATLRDLKVVGKDKAVVNFGLDLPVPEDKQIVNFTYLVRDADGKPIENLEYYNNSGNSLILPYGKYTVELLTYDTNAAKLESDKIVSFTLSADNNFQQVTFKMTMLATSQITAHFDHLLPEGSRVSLKTAQGQLIPLEQSLYVPKAYGKTVQEGTYEVVVSLPKGYRIEGDTKVNALPNEVHELSLRLVKVGDASDSTGDHKVMSKNNSQALTASATPTKTTTSATAKALPSAGEKMGLKLRIVGLVLLGLTCVFSRKKSTKD

SEQ ID NO: 51 - protein, 1647 aa, Streptococcus pyogenes
VEKKQRFSLRKYKSGTFSVLIGSVFLMMTTTVAADELTTTSEPTITNHTQQQAQHLTNTELSSAESKPQDTSQITLKTNREKEQPQGLVSEPTTTELADTDAAPMANTGPDATQKSASLPPVNTDVHDWVKTKGAWDKGYKGQGKVVAVIDTGIDPAHQSMRISDVSTAKVKSKEDMLARQKAAGINYGSWINDKVVFAHNYVENSDNIKENQFEDFDEDWENFEFDAEAEPKAIKKHKIYRPQSTQAPKETVIKTEETDGSHDIDWTQTDDDTKYESHGMHVTGIVAGNSKEAAATGERFLGIAPEAQVMFMRVFANDVMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKNIKDSLGYDKSHQFAYVKESTDAGYNAQNVKGKIALIERDPNKTYDEMIALAKKHGALGVLIFNNKPGQSNRSMRLTANGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKAKTLRYDTELLTDHVDPQKGRFTLTSRSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGYYHYVVSYYPDVVGAKRQEMTFDMILDRQKPVLSQATFDPETNRFKPEPLKDRGLAGVRKDSVFYLERKDNKPYTVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASASAIESTAWYGITARGSKVMPGDYQYVVTYRDEHGKEHQKQYTISVNDKKPMITQGRFDTINGVDHFTPDKTKALGSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKMTMLATSQITAHFDHLLPEGSRVSLKTAQGQLIPLEQSLYVPKAYGKTVQEGTYEVVVSLPKGYRIEGNTKVNTLPNEVHELSLRLVKVGDASDSTGDHKVMSKNNSQALTASATPTKTTTSATAKALPSAGEKMGLKLRIVGLVLLGLTCVFSRKKSTKD

SEQ ID NO: 52 - protein, 1647 aa, Streptococcus pyogenes
VEKKQRFSLRKYKSGTFSVLIGSVFLMMTTTVAADELTTTSEPTITNHTQQQAQHLTNTELSSAESKPQDTSQITLKTNREKEQPQGLVSEPTTTELADTDAAPMANTGPDATQKSASLPPVNTDVHDWVKTKGAWDKGYKGQGKVVAVIDTGIDPAHQSMRISDVSTAKVKSKEDMLARQKAAGINYGSWINDKVVFAHNYVENSDNIKENQFEDFDEDWENFEFDAEAEPKAIKKHKIYRPQSTQAPKETVIKTEETDGSHDIDWTQTDDDTKYESHGMHVTGIVAGNSKEAAATGERFLGIAPEAQVMFMRVFANDVMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKNIKDSLGYDKSHQFAYVKESTDAGYNAQNVKGKIALIERDPNKTYDEMIALAKKHGALGVLIFNNKPGQSNRSMRLTANGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKAKTLRYDTELLTDHVDPQKGRFTLTSRSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNVDGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGYYHYVVSYYPDVVGAKRQEMTFDMILDRQKPVLSQATFDPETNRFKPEPLKDRGLAGVRKDSVFYLERKDNKPYTVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASASAIESTAWYGITARGSKVMPGDYQYVVTYRDEHGKEHQKQYTISVNDKKPMITQGRFDTINGVDHFTPDKTKALGSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKMTMLATSQITAHFDHLLPEGSRVSLKTAQGQLIPLEQSLYVPKAYGKTVQEGTYEVVVSLPKGYRIEGNTKVNTLPNEVHELSLRLVKVGDASDSTGDHKVMSKNNSQALTASATPTKTTTSATAKALPSAGEKMGLKLRIVGLVLLGLTCVFSRKKSTKD

SEQ ID NO: 53 - protein, 1647 aa, Streptococcus pyogenes; identical to SEQ ID NO: 52

SEQ ID NO: 54 - protein, 1647 aa, Streptococcus pyogenes; identical to SEQ ID NO: 52

SEQ ID NO: 55 - protein, 1647 aa, Streptococcus pyogenes; identical to SEQ ID NO: 52

SEQ ID NO: 56 - protein, 1647 aa, Streptococcus pyogenes; identical to SEQ ID NO: 52

SEQ ID NO: 57 - protein, 101 aa, Homo sapiens
MSSAAGFCASRPGLLFLGLLLLPLVVAFASAEAEEDGDLQCLCVKTTSQVRPRHITSLEVIKAGPHCPTAQLIATLKNGRKICLDLQAPLYKKIIKKLLES

SEQ ID NO: 58 - protein, 128 aa, Homo sapiens
MSLRLDTTPSCNSARPLHALQVLLLLSLLLTALASSTKGQTKRNLAKGKEESLDSDLYAELRCMCIKTTSGIHPKNIQSLEVIGKGTHCNQVEVIATLKDGRKICLDPDAPRIKKIVQKKLAGDESAD

SEQ ID NO: 59 - protein, 107 aa, Homo sapiens
MARAALSAAPSNPRLLRVALLLLLLVAAGRRAAGASVATELRCQCLQTLQGIHPKNIQSVNVKSPGPHCAQTEVIATLKNGRKACLNPASPIVKKIIEKMLNSDKSN

SEQ ID NO: 60 - protein, 107 aa, Homo sapiens
MARATLSAAPSNPRLLRVALLLLLLVAASRRAAGAPLATELRCQCLQTLQGIHLKNIQSVKVKSPGPHCAQTEVIATLKNGQKACLNPASPMVKKIIEKMLKNGKSN

SEQ ID NO: 61 - protein, 107 aa, Homo sapiens
MAHATLSAAPSNPRLLRVALLLLLLVAASRRAAGASVVTELRCQCLQTLQGIHLKNIQSVNVRSPGPHCAQTEVIATLKNGKKACLNPASPMVQKIIEKILNKGSTN

SEQ ID NO: 62 - protein, 114 aa, Homo sapiens
MSLPSSRAARVPGPSGSLCALLALLLLLTPPGPLASAGPVSAVLTELRCTCLRVTLRVNPKTIGKLQVFPAGPQCSKVEVVASLKNGKQVCLDPEAPFLKKVIQKILDSGNKKN

SEQ ID NO: 63 - protein, 89 aa, Homo sapiens
MNAKVVVVLVLVLTALCLSDGKPVSLSYRCPCRFFESHVARANVKHLKILNTPNCALQIVARLKNNNRQVCIDPKLKWIQEYLEKALNK

SEQ ID NO: 64 - protein, 119 aa, Homo sapiens
MNAKVVVVLVLVLTALCLSDGKPVSLSYRCPCRFFESHVARANVKHLKILNTPNCALQIVARLKNNNRQVCIDPKLKWIQEYLEKALNKGRREEKVGKKEKIGKKKRQKKRKAAQKRKN

SEQ ID NO: 65 - protein, 93 aa, Homo sapiens
MNAKVVVVLVLVLTALCLSDGKPVSLSYRCPCRFFESHVARANVKHLKILNTPNCALQIVARLKNNNRQVCIDPKLKWIQEYLEKALNKRFKM

SEQ ID NO: 66 - protein, 125 aa, Homo sapiens
MKKSGVLFLLGIILLVLIGVQGTPVVRKGRCSCISTNQGTIHLQSLKDLKQFAPSPSCEKIEIIATLKNGVQTCLNPDSADVKELIKKWEKQVSQKKKQKNGKKHQKKKVLKVRKSQRSRQKKTT

SEQ ID NO: 67 - protein, 98 aa, Homo sapiens
MNQTAILICCLIFLTLSGIQGVPLSRTVRCTCISISNQPVNPRSLEKLEIIPASQFCPRVEIIATMKKKGEKRCLNPESKAIKNLLKAVSKERSKRSP

SEQ ID NO: 68 - protein, 94 aa, Homo sapiens
MSVKGMAIALAVILCATVVQGFPMFKRGRCLCIGPGVKAVKVADIEKASIMYPSNNCDKIEVIITLKENKGQRCLNPKSKQARLIIKKVERKNF

SEQ ID NO: 69 - DNA, 28 bp, Streptococcus pyogenes
gtgcgtcatatggcagatgagctaagca

SEQ ID NO: 70 - DNA, 31 bp, Streptococcus pyogenes
gcgtctcgagggcttttgctgttgctgaggt

SEQ ID NO: 71 - DNA, 34 bp, Streptococcus pyogenes
gcgtctcgagttaggcttttgctgttgctgaggt

SEQ ID NO: 72 - DNA, 21 bp, Streptococcus pyogenes
ccctgtggcaataactgcgac

SEQ ID NO: 73 - DNA, 21 bp, Streptococcus pyogenes
cgcagttattgccacagggat

SEQ ID NO: 74 - DNA, 30 bp, Streptococcus pyogenes
ctgactgagtcgacagactctgaatagatg

SEQ ID NO: 75 - DNA, 34 bp, Streptococcus pyogenes
ctgactgagtcgactttaaagacataaaagatag

SEQ ID NO: 76 - DNA, 21 bp, Streptococcus pyogenes
gagaggccatagctgttcctg

SEQ ID NO: 77 - DNA, 21 bp, Streptococcus pyogenes
ggaacagctatggcctctcct

SEQ ID NO: 78 - DNA, 4740 bp, Streptococcus pyogenes
gcagatgagctaagcacaatgagcgaaccaacaatcacgaatcacgctcaacaacaagcgcaacatctcaccaatacagagttgagctcagctgaatcaaaatctcaagacacatcacaaatcactctcaagacaaatcgtgaaaaagagcaatcacaagatctagtctctgagccaaccacaactgagctagctgacacagatgcagcatcaatggctaatacaggttctgatgcgactcaaaaaagcgcttctttaccgccagtcaatacagatgttcacgattgggtaaaaaccaaaggagcttgggacaagggatacaaaggacaaggcaaggttgtcgcagttattgacacagggatcgatccggcccatcaaagcatgcgcatcagtgatgtatcaactgctaaagtaaaatcaaaagaagacatgctagcacgccaaaaagccgccggtattaattatgggagttggataaatgataaagttgtttttgcacataattatgtggaaaatagcgataatatcaaagaaaatcaattcgaggattttgatgaggactgggaaaactttgagtttgatgcagaggcagagccaaaagccatcaaaaaacacaagatctatcgtccccaatcaacccaggcaccgaaagaaactgttatcaaaacagaagaaacagatggttcacatgatattgactggacacaaacagacgatgacaccaaatacgagtcacacggtatgcatgtgacaggtattgtagccggtaatagcaaagaagccgctgctactggagaacgctttttaggaattgcaccagaggcccaagtcatgttcatgcgtgtttttgccaacgacatcatgggatcagctgaatcactctttatcaaagctatcgaagatgccgtggctttaggagcagatgtgatcaacctgagtcttggaaccgctaatggggcacagcttagtggcagcaagcctctaatggaagcaattgaaaaagctaaaaaagccggtgtatcagttgttgtagcagcaggaaatgagcgcgtctatggatctgaccatgatgatccattggcgacaaatccagactatggtttggtcggttctccctcaacaggtcgaacaccaacatcagtggcagctataaacagtaagtgggtgattcaacgtctaatgacggtcaaagaattagaaaaccgtgccgatttaaaccatggtaaagccatctattcagagtctgtcgactttaaagacataaaagatagcctaggttatgataaatcgcatcaatttgcttatgtcaaagagtcaactgatgcgggttataacgcacaagacgttaaaggtaaaattgctttaattgaacgtgatcccaataaaacctatgacgaaatgattgctttggctaagaaacatggagctctgggagtacttatttttaataacaagcctggtcaatcaaaccgctcaatgcgtctaacagctaatgggatggggataccatctgctttcatatcgcacgaatttggtaaggccatgtcccaattaaatggcaatggtacaggaagtttagagtttgacagtgtggtctcaaaagcaccgagtcaaaaaggcaatgaaatgaatcatttttcaaattggggcctaacttctgatggctatttaaaacctgacattactgcaccaggtggcgatatctattctacctataacgataaccactatggtagccaaacaggaacaagtatggcctctcctcagattgctggcgccagccttttggtcaaacaatacctagaaaagactcagccaaacttgccaaaagaaaaaattgctgatatcgttaagaacctattgatgagcaatgctcaaattcatgttaatccagagacaaaaacgaccacctcaccgcgtcagcaaggggcaggattacttaatattgacggagctgtcactagcggcctttatgtgacaggaaaagacaactatggcagtatatcattaggcaacatcacagatacgatgacgtttgatgtgactgttcacaacctaagcaataaagacaaaacattacgttatgacacagaattgctaacagatcatgtagacccacaaaagggccgcttcactttgacttctcactccttaaaaacgtaccaaggaggagaagttacagtcccagccaatggaaaagtgactgtaagggttaccatggatgtctcacagttcacaaaagagctaacaaaacagatgccaaatggttactatctagaaggttttgtccgctttagagatagtcaagatgaccaactaaatagagtaaacattccttttgttggttttaaagggcaatttgaaaacttagcagttgcagaagagtccatttacagattaaaatctcaaggcaaaactggtttttactttgatgaatcaggtccaaaagacgatatctatgtcggtaaacactttacaggacttgtcactcttggttcagagaccaatgtgtcaaccaaaacgatttctgacaatggtctacacacacttggcacctttaaaaatgcagatggcaaatttatcttagaaaaaaatgcccaaggaaaccctgtcttagccatttctccaaatggtgacaacaaccaagattttgcagccttcaaaggtgttttcttgagaaaatatcaaggcttaaaagcaagtgtctaccatgctagtgacaaggaacacaaaaatccactgtgggtcagcccagaaagctttaaaggagataaaaactttaatagtgacattagatttgcaaaatcaacgaccctgttaggcacagcattttctggaaaatcgttaacaggagctgaattaccagatgggcattatcattatgtggtgtcttattacccagatgtggtcggtgccaaacgtcaagaaatgacatttgacatgattttagaccgacaaaaaccggtactatcacaagcaacatttgatcctgaaacaaaccgattcaaaccagaacccctaaaagaccgtggattagctggtgttcgcaaagacagtgtcttttatctagaaagaaaagacaacaagccttatacagttacgataaacgatagctacaaatatgtctcagtagaagacaataaaacatttgtggagcgacaagctgatggcagctttatcttgccgcttgataaagcaaaattaggggatttctattacatggtcgaggattttgcagggaacgtggccatcgctaagttaggagatcacttaccacaaacattaggtaaaacaccaattaaacttaagcttacagacggtaattatcagaccaaagaaacgcttaaagataatcttgaaatgacacagtctgacacaggtctagtcacaaatcaagcccagctagcagtggtgcaccgcaatcagccgcaaagccagctaacaaagatgaatcaggatttctttatctcaccaaacgaagatgggaataaagactttgtggcctttaaaggcttgaaaaataacgtgtataatgacttaacggttaacgtatacgctaaagatgaccaccaaaaacaaacccctatctggtctagtcaagcaggcgctagtgtatccgctattgaaagtacagcctggtatggcataacagcccgaggaagcaaggtgatgccaggtgattatcagtatgttgtgacctatcgtgacgaacatggtaaagaacatcaaaagcagtacaccatatctgtgaatgacaaaaaaccaatgatcactcagggacgttttgataccattaatggcgttgaccactttactcctgacaagacaaaagcccttgactcatcaggcattgtccgcgaagaagtcttttacttggccaagaaaaatggccgtaaatttgatgtgacagaaggtaaagatggtatcacagttagtgacaataaggtgtatatccctaaaaatccagatggttcttacaccatttcaaaaagagatggtgtcacactgtcagattattactaccttgtcgaagatagagctggtaatgtgtcttttgctaccttgcgtgacctaaaagcggtcggaaaagacaaagcagtagtcaattttggattagacttaccggtccctgaagacaaacaaatagtgaactttacctaccttgtgcgggatgcagatggtaaaccgattgaaaacctagagtattataataactcaggtaacagtcttatcttgccatacggcaaatacacggtcgaattgttgacctatgacaccaatgcagccaaactagagtcagataaaatcgtttcctttaccttgtcagctgataacaacttccaacaagttacctttaagataacgatgttagcaacttctcaaataactgcccactttgatcatcttttgccagaaggcagtcgcgttagccttaaaacagctcaagatcagctaatcccgcttgaacagtccttgtatgtgcctaaagcttatggcaaaaccgttcaagaaggcacttacgaagttgttgtcagcctgcctaaaggctaccgtatcgaaggcaacacaaaggtgaataccctaccaaatgaagtgcacgaactatcattacgccttgtcaaagtaggagatgcctcagattcaactggtgatcataaggttatgtcaaaaaataattcacaggctttgacagcctctgccacaccaaccaagtcaacgacctcagcaacagcaaaagcc

SEQ ID NO: 79 - protein, 1580 aa, Streptococcus pyogenes
ADELSTMSEPTITNHAQQQAQHLTNTELSSAESKSQDTSQITLKTNREKEQSQDLVSEPTTTELADTDAASMANTGSDATQKSASLPPVNTDVHDWVKTKGAWDKGYKGQGKVVAVIDTGIDPAHQSMRISDVSTAKVKSKEDMLARQKAAGINYGSWINDKVVFAHNYVENSDNIKENQFEDFDEDWENFEFDAEAEPKAIKKHKIYRPQSTQAPKETVIKTEETDGSHDIDWTQTDDDTKYESHGMHVTGIVAGNSKEAAATGERFLGIAPEAQVMFMRVFANDIMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKDIKDSLGYDKSHQFAYVKESTDAGYNAQDVKGKIALIERDPNKTYDEMIALAKKHGALGVLIFNNKPGQSNRSMRLTANGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKDKTLRYDTELLTDHVDPQKGRFTLTSHSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGHYHYVVSYYPDVVGAKRQEMTFDMILDRQKPVLSQATFDPETNRFKPEPLKDRGLAGVRKDSVFYLERKDNKPYTVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASVSAIESTAWYGITARGSKVMPGDYQYVVTYRDEHGKEHQKQYTISVNDKKPMITQGRFDTINGVDHFTPDKTKALDSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKITMLATSQITAHFDHLLPEGSRVSLKTAQDQLIPLEQSLYVPKAYGKTVQEGTYEVVVSLPKGYRIEGNTKVNTLPNEVHELSLRLVKVGDASDSTGDHKVMSKNNSQALTASATPTKSTTSATAKA

SEQ ID NO: 80 - protein, 1649 aa, Streptococcus pyogenes
VEKKQRFSLRKYKSGTFSVLIGSVFLMMMMTTTVAADELTTTSEPTITNHAQQQAQHLTNTELSSAESKPQDTSQITPKTNREKEQSQDLVSEPTTTELADTDAASMANTGPDATQKSASLPPVNTDVHDWVKTKGAWGKGYKGQGKVVAVIDTGIDPAHQSMRISDVSTAKVKSKEDMLARQKAAGINYGSWINDKVVFAHNYVENSDNIKENQFEDFDEDWENFEFDADAEPKAIKKHKIYRPQSTQAPKETVIKTEETDGSHDIDWTQTDDDTKYESHGMHVTGIVAGNSKEAAATGERFLGIAPEAQVMFMRVFANDVMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKNIKDSLGYDKSHQFAYVKESTDAGYNAQDVKGKIALIERDPNKTYDEMIALAKKHGALGVLIFNNKPGQSNRSMRLTANGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKDKTLRYDTELLTDHVDPQKGRFTLTSRSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGYYHYVVSYYPDVVGAKRQEMTFDMILDRQKPVLSQATFDPETNRFKPEPLKDRGLAGVRKDSVFYLERKDNKPYTVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASASAIESTAWYGITARGSKVMPGDYQYVVTYRDEHGKVHQKQYTISVNDKKPMITQGRFDTINGVDHFTPDKTKALGSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKMTMLATSQITAHFDHLLPEGSRVSLKTAQGQLIPLEQSLYVPKAYGKTVQEGTYEVVVSLPKGYRIEGNTKVNTLPNEVHELSLRLVKVGDASDSTGDHKVMSKNNSQALTASATPTKTTTSATAKALPSTGEKMGLKLRIVGLVLLGLTCVFSRKKSTKD

SEQ ID NO: 81 - protein, 99 aa, Homo sapiens
MTSKLAVALLAAFLISAALCEGAVLPRSAKELRCQCIKTYSKPFHPKFIKELRVIESGPHCANTEIIVKLSDGRELCLDPKENWVQRVVEKFLKRAENS

SEQ ID NO: 82 - protein, 114 aa, Homo sapiens
MSLLSSRAARVPGPSSSLCALLVLLLLLTQPGPIASAGPAAAVLRELRCVCLQTTQGVHPKMISNLQVFAIGPQCSKVEVVASLKNGKEICLDPEAPFLKKVIQKILDGGNKEN

SEQ ID NO: 83 - protein, 109 aa, Homo sapiens
MKFISTSLLLMLLVSSLSPVQGVLEVYYTSLRCRCVQESSVFIPRRFIDRIQILPRGNGCPRKEIIVWKKNKSIVCVDPQAEWIQRMMEVLRKRSSSTLPVPVFKRKIP

SEQ ID NO: 84 - protein, 99 aa, Homo sapiens
MRLLAAALLLLLLALYTARVDGSKCKCSRKGPKIRYSDVKKLEMKPKYPHCEEKMVIITTKSVSRYRGQEHCLHPKLQSTKRFIKWYNAWNEKRRVYEE

SEQ ID NO: 85 - protein, 254 aa, Homo sapiens
MGRDLRPGSRVLLLLLLLLLVYLTQPGNGNEGSVTGSCYCGKRISSDSPPSVQFMNRLRKHLRAYHRCLYYTRFQLLSWSVCGGNKDPWVQELMSCLDLKECGHAYSGIVAHQKHLLPTSPPISQASEGASSDIHTPAQMLLSTLQSTQRPTLPVGSLSSDKELTRPNETTIHTAGHSLAAGPEAGENQKQPEKNAGPTARTSATVPVLCLLAIIFILTAALSYVLCKRRRGQSPQSSPDLPVHYIPVAPDSNT

The invention claimed is:

1. A purified mutant Spy0416 antigen comprising the amino acid sequence of SEQ ID NO: 4.

2. A composition comprising an isolated mutant Spy0416 antigen comprising the amino acid sequence of SEQ ID NO: 4 and a pharmaceutically acceptable carrier.

3. The composition of claim 2, further comprising an adjuvant.

4. A method of making a composition for immunization of a mammal against *Streptococcus pyogenes* comprising combining (A) an isolated mutant Spy0416 antigen comprising the amino acid sequence of SEQ ID NO: 4 and
(B) a pharmaceutically acceptable carrier.

5. A method of immunizing a mammal against *Streptococcus pyogenes* comprising administering to said mammal a dose of a composition comprising an isolated mutant Spy0416 antigen comprising the amino acid sequence of SEQ ID NO: 4 and a pharmaceutically acceptable carrier.

* * * * *